United States Patent
Ahlfors et al.

(10) Patent No.: US 12,024,722 B2
(45) Date of Patent: Jul. 2, 2024

(54) METHODS FOR REPROGRAMMING CELLS AND USES THEREOF

(71) Applicant: Genesis Technologies Limited, St. Michael (BB)

(72) Inventors: Jan-Eric Ahlfors, Laval (CA); Rouwayda El-Ayoubi, Laval (CA)

(73) Assignee: Genesis Technologies Limited, St. Michael (BB)

( * ) Notice: Subject to any disclaimer, the term of this patent is extended or adjusted under 35 U.S.C. 154(b) by 927 days.

(21) Appl. No.: 16/125,528

(22) Filed: Sep. 7, 2018

(65) Prior Publication Data

US 2019/0024056 A1    Jan. 24, 2019

Related U.S. Application Data

(63) Continuation of application No. 14/958,791, filed on Dec. 3, 2015, now abandoned, which is a continuation of application No. 13/843,713, filed on Mar. 15, 2013, now abandoned, which is a continuation-in-part of application No. 13/464,987, filed on May 5, 2012, now Pat. No. 9,453,205, which is a continuation-in-part of application No. 13/504,988, filed as application No. PCT/CA2010/001727 on Nov. 1, 2010, now Pat. No. 9,528,087.

(60) Provisional application No. 61/256,967, filed on Oct. 31, 2009.

(51) Int. Cl.
| | |
|---|---|
| C12N 5/00 | (2006.01) |
| C12N 5/071 | (2010.01) |
| C12N 5/074 | (2010.01) |
| C12N 5/0775 | (2010.01) |
| C12N 5/0789 | (2010.01) |
| C12N 5/0797 | (2010.01) |
| C12N 15/85 | (2006.01) |

(52) U.S. Cl.
CPC ......... *C12N 5/0696* (2013.01); *C12N 5/0623* (2013.01); *C12N 5/0647* (2013.01); *C12N 5/0662* (2013.01); *C12N 5/0678* (2013.01); *C12N 15/85* (2013.01); *C12N 2501/40* (2013.01); *C12N 2501/60* (2013.01); *C12N 2501/603* (2013.01); *C12N 2501/604* (2013.01); *C12N 2501/605* (2013.01); *C12N 2501/998* (2013.01); *C12N 2502/99* (2013.01); *C12N 2506/094* (2013.01); *C12N 2506/11* (2013.01); *C12N 2506/1307* (2013.01); *C12N 2506/1384* (2013.01)

(58) Field of Classification Search
None
See application file for complete search history.

(56) References Cited

U.S. PATENT DOCUMENTS

| | | | |
|---|---|---|---|
| 6,087,168 A | 7/2000 | Levesque | |
| 6,949,380 B1 | 9/2005 | Levesque | |
| 9,453,205 B2 | 9/2016 | Ahlfors et al. | |
| 9,528,087 B2 | 12/2016 | Ahlfors et al. | |
| 10,017,737 B2 | 7/2018 | Ahlfors et al. | |
| 10,131,879 B2 | 11/2018 | Ahlfors et al. | |
| 10,260,046 B2 | 4/2019 | Ahlfors et al. | |
| 10,557,123 B2 | 2/2020 | Ahlfors et al. | |
| 10,563,176 B2 | 2/2020 | Ahlfors et al. | |
| 2002/0136709 A1 | 9/2002 | Zahner et al. | |
| 2003/0059939 A1 | 3/2003 | Page | |
| 2003/0217378 A1 | 11/2003 | Stice et al. | |
| 2008/0152630 A1 | 6/2008 | Ginis | |
| 2008/0254004 A1 | 10/2008 | Terskikh et al. | |
| 2009/0136461 A1 | 5/2009 | Kim | |
| 2009/0162329 A1 | 6/2009 | Anversa | |
| 2011/0206644 A1 | 8/2011 | Estrov et al. | |
| 2011/0223670 A1 | 9/2011 | Schwartz et al. | |
| 2012/0129262 A1* | 5/2012 | West | C12N 5/0696 435/455 |
| 2012/0220034 A1 | 8/2012 | Ahlfors et al. | |
| 2012/0288936 A1 | 11/2012 | Ahlfors et al. | |
| 2013/0064799 A1* | 3/2013 | Rana | C12N 5/0696 435/7.1 |

(Continued)

FOREIGN PATENT DOCUMENTS

| | | |
|---|---|---|
| CA | 2698091 | 3/2009 |
| CA | 2660123 | 4/2009 |

(Continued)

OTHER PUBLICATIONS

Wang et al. PNAS 102(52):19081-19086, 2005 (Year: 2005).*

(Continued)

*Primary Examiner* — Marcia S Noble

(74) *Attorney, Agent, or Firm* — Knobbe, Martens, Olson & Bear, LLP

(57) ABSTRACT

Described herein are reprogrammed cells, and methods for cell dedifferentiation, transformation and eukaryotic cell reprogramming. Also described are cells, cell lines, and tissues that can be transplanted in a patient after steps of in vitro dedifferentiation and in vitro reprogramming. In particular embodiments the cells are Stem-Like Cells (SLCs), including Neural Stem-Like Cells (NSLCs), Cardiac Stem-Like Cells (CSLC), Hematopoietic Stem-Like Cells (HSLC), Pancreatic Progenitor-Like Cells, and Mesendoderm-like Cells. Also described are methods for generating these cells from human somatic cells and other types of cells. Also provided are compositions and methods of using of the cells so generated in human therapy and in other areas.

9 Claims, No Drawings

Specification includes a Sequence Listing.

(56) References Cited

U.S. PATENT DOCUMENTS

| | | |
|---|---|---|
| 2013/0097717 A1 | 4/2013 | Zhu |
| 2014/0301991 A1 | 10/2014 | Srivastava |
| 2015/0004145 A1 | 1/2015 | Lemischka et al. |
| 2016/0032317 A1* | 2/2016 | Rossi ............... C12N 15/86 435/456 |
| 2016/0160184 A1 | 6/2016 | Ahlfors et al. |
| 2016/0298086 A1 | 10/2016 | Terzic et al. |
| 2017/0029783 A1 | 2/2017 | Ahlfors et al. |
| 2017/0101622 A1 | 4/2017 | Ahlfors et al. |
| 2017/0101623 A1 | 4/2017 | Ahlfors et al. |
| 2017/0101626 A1 | 4/2017 | Ahlfors et al. |
| 2019/0085294 A1 | 3/2019 | Ahlfors et al. |
| 2020/0165570 A1 | 5/2020 | Ahlfors et al. |
| 2020/0263140 A1 | 8/2020 | Ahlfors et al. |

FOREIGN PATENT DOCUMENTS

| | | |
|---|---|---|
| EP | 1 022 330 | 7/2000 |
| EP | 2 096 169 | 9/2009 |
| KR | 20040016785 A | 2/2004 |
| WO | WO 03/018767 A2 | 3/2003 |
| WO | WO 2007/097494 | 8/2007 |
| WO | WO 2009/018832 | 2/2009 |
| WO | WO 2009/057831 | 5/2009 |
| WO | WO 2009/079007 | 6/2009 |
| WO | WO 2010/052904 | 5/2010 |
| WO | WO 2010/088735 | 8/2010 |

OTHER PUBLICATIONS

GATA2 sheet (NM_001145661 NCBI GeneBank Nucleotide Published sequence. See printout dated Mar. 17, 2022 pp. 1-5). (Year: 2022).*

Abeliovich, et al. 2009 "Reprogramming therapeutics: IPS cell prospects for neurodegenerative disease", *Neuron*; 61(3): 337-339.

Akazawa, et al. 1995 "A mammalian helix-loop-hetlix factor structurally related to the product of *Drosophila* proneural gene atonal is a positive transcriptional regulator express in the developing nervous system" *J Biol. Chem* 270(15): 8730-8738.

Baghbaderani, B.A., et al., 2009 "Bioreactor Expansion of Human Neural Precursor Cells in Serum-Free Media Retains Neurogenic Potential" *Biotechnol Bioeng* 105: 823-833.

Bertrand, et al. 2002 "Proneural genes and the specification of neural cell types" *Nat Rev Neurosci* 3(7): 517-530.

Bouwens, et al. 1998 "Cytokeratins and cell differentiation in the pancreas" *J. Pathol.* 184: 234-239.

Bouwens 1998 "Transdifferentiation versus stem cell hypothesis for the regeneration of islet beta-cells in the pancreas" *Micro Res Tech*. 43(4): 332-336.

Brunet, et al. 1999 "Deconstructing cell determination: proneural genes and neuronal identity" *BioEssays* 21: 313-318.

Caporaso, et al. 2003 "Telomerase activity in the subventricular zone of adult mice" *Mol Cel Neurosci* 23(4): 693-702.

Chambers, et al. 2009 "Highly efficient neural conversion of human ES and IPS cells by dual inhibition of SMAD signaling" *Nat Biotech*. 27(3): 275-280.

Davis, Robert L. et al., "Expression of a single transfected cDNA converts fibroblasts to myoblasts," Cell, Dec. 24, 1987, vol. 51, Issue 6, pp. 987-1000.

Detich et al. 2002 "Promoter-specific Activation and Demethylation by MBD2/Demethylase" *J Biol Chem* 277: 35791-35794.

European Office Action dated Feb. 13, 2017, issued In European Application No. 10 825 907.8, 5 pages.

Extended European Search Report in European Application No. 10 825 907.8, dated Jun. 17, 2013.

Feng, et al. 2009 "Reprogramming of fibroblasts into induced pluripotent stem cells with orphan nuclear receptor Esrrb" *Nat Cell Biol*. 11(2): 197-203.

Fernandes, et al. 2004 "A dermal niche for multipotent adult skin-derived precursor cells" *Nat Cell Biol*. 6: 1082-1093.

Fode, et al. 1998 "The bHLH 5 protein NEUROGENIN 2 is a determination factor for epibranchial placode-derived sensory neurons" *Neuron* 20(3): 483-494.

Frohman, et al. 2006 "Most patients with multiple sclerosis or a clinically isolated demyelinating syndrome should be treated at the time of diagnosis" *Arch Neurol*. 63(4): 614-619.

Gash, et al. 1996 "Functional recovery in parkinsonian monkeys treated with GDNF" *Nature* 380: 252-255.

Gene ID: 4152 2015 "MBD1 methyl-CpG binding domain protein 1 [ *Homo sapiens* (human) ]" downloaded on Dec. 19, 2015 from the World-Wide-Web at: ncbi.nlm.nih.gov/gene?cmd=Retrieve&dopt=full_report&list_uids=4152.

Gene ID: 8932 2015 "MBD2 methyl-CpG binding domain protein 2 [ *Homo sapiens* (human) ]" downloaded on Dec. 19, 2015 from the World-Wide-Web at: ncbi.nlm.nih.gov/gene?cmd=Retrieve&dopt=full_report&list_uids=8932.

Gene ID: 53615 2015 "MBD3 methyl-CpG binding domain protein 3 [ *Homo sapiens* (human) ]" downloaded on Dec. 19, 2015 from the World-Wide-Web at: ncbi.nlm.nih.gov/gene?cmd=Retrieve&dopt=full_report&list_uids=53615.

Gene ID: 8930 2015 "MBD4 methyl-CpG binding domain 4 DNA glycosylase [ *Homo sapiens* (human) ]" downloaded on Dec. 19, 2015 from the World-Wide-Web at: ncbi.nlm.nih.gov/gene?cmd=Retrieve&dopt=full_report&list_uids=8930.

Gene ID: 4204 2015 "MECP2 methyl-CpG binding protein 2 [ *Homo sapiens* (human) ]" downloaded on Dec. 19, 2015 from the World-Wide-Web at: ncbi.nlm.nih.gov/gene?cmd=Retrieve&dopt=full_report&list_uids=4204.

Gene ID: 57379 2015 "AICDA activation-induced cytidine deaminase [ *Homo sapiens* (human) ]" downloaded on Dec. 19, 2015 from the World-Wide-Web at: ncbi.nlm.nih.gov/gene?cmd=Retrieve&dopt=full_report&list_uids=57379.

Goffin & Eisenhauer 2002 "DNA methyltransferase inhibitors—state of the art" *Anals of Oncology* 13: 1699-1716.

Guillemot, et al. 1993 "Mammalian achaete-scute homolog 1 is required for the early development of olfactory and autonomic neurons" *Cell* 75(3): 463-476.

Jacobson, et al. 2006 "Polybrene improves transfection efficacy of recombinant arepolication-deficient adenovirus in cutaneous cells and burned skin" *J Gene Med*. 8: 138-146.

Johnson, et al. 1990 "Two rat homologues of *Drosophila* achaete-scute specifically expressed in neuronal precursors" *Nature* 346(6287): 858-861.

Kaji, et al. 2009 "Virus-free induction of pluripotency and subsequent excision of reprogramming factors" *Nature Letters* 458: 771-775.

Kaneko, et al. 2000 "Musashi1: an evolutionally conserved marker for CNS progenitor cells including neural stem cells" *Dev Neurosci*. 22(1-2): 139-153.

Keans, et al. 1995 "GDNF protects nigral dopamine neurons against 6-hydroxydopamine in vivo" *Brain Res*. 672: 104-111.

Kim, et al. 2009 "Generation of human induced pluripotent stem cells by direct delivery of reprogramming proteins" *Cell Stem Cell* 4(6): 472-476.

Kelaini, S. et al., "Direct reprogramming of adult cells: avoiding the pluripotent state," Stem Cell and Cloning: Advances and Applications, Feb. 1, 2014, pp. 19-29.

Kordower, et al. "Neurodegeneration prevented by lentiviral vector delivery of GDNF in ptimate models of Parkinson disease" *Science* 290: 5492.

Kuo & Allis 1998 "Roles of histone acetyltransferases and deacetylases in gene regulation" *BioEssays* 20: 615-626.

Langer-Gould, et al. 2004 "Strategies for managing the side effects of treatments for multiple sclerosis" *Neurology* 63(suppl5): S35-41.

Lee, J. et al. 2003 "Cellular and Genetic Characterization of Human Adult Bone Marrow-Derived Neural Stem-Like Cells: A Potential Antiglioma Cellular Vector" *Cancer Res* 63: 8877-8889.

Lyko & Brown 2005 "DNA Methyltransferase Inhibitors and the Development of Epigenetic Cancer Therapies" *JNCI* 97: 1498-1506.

Lyssiotis, et al. 2009 "Reprogramming of murine fibroblasts to induced pluripotent stem cells with chemical complementation of Klf" *PNAS* 106(22): 8912-8917.

(56) References Cited

OTHER PUBLICATIONS

Martin et al. 2004 "Neural cell adhesion molecule expression in plasma cells in bone marrow biopsies and aspirates allows discrimination between multiple myeloma, monoclonal gammopathy of uncertain significance and polyclonal plasmacytosis" *Histopathology* 44: 375-380.
Martinez-Serrano, et al. 1997 "Immortalized neural progenitor cells for CNS gene transfer and repair" *Trends Neurosci*.20: 530-538.
Martino, et al. 2006 "The therapeutic potential of neural stem cells" *Nature Rev.* 7: 395-406.
McCormick, et al. 1996 "NeuroD2 and neuroD3: distinct expression patterns and transcriptional activation potentials within the neuroD gene family" *Mol Cell Biol.* 16(10): 5792-5800.
Mendez-Ferrer et al. 2010 "Mesenchymal and haematopoietic stem cells form a unique bone marrow niche" *Nature* 466: 829-836.
Mimeault, et al. 2007 "Stem cells: a revolution in therapeutics-recent advances in stem cell biology and their therapeutic applications in regenerative medicine and cancer therapies" *Clin Pharmacol Ther* 82: 252-264.
Miyata, et al. 1999 "NeuroD is required for differentiation of the granule cells in the cerebellum and hippocampus" *Genes Dev.* 13(13): 1647-1652.
Okabe, S. et al. 1996 "Development of neuronal precursor cells and functional postmitotic neurons from embryonic stem cells in vitro." *Mechanisms of Development* 59: 89-102.
Okada, Y et al. 2008 "Spatiotemporal recapitulation of central nervous system development by murine embryonic stem cell-derived neural stem/progenitor cells" *Stem Cells* 26: 3086-3098.
Okano, H., 2009 "A strategy for neuronal regeneration using iPS cells" *Geriatric Medicine* 47: 1369-1377.
Okita, et al. 2010 "Generation of mouse-induced pluripotent stem cells with plasmid vectors" *Nat Protoc.* 5(3): 418-427.
Ostenfeld, T. et al. 2000 "Human Neural Precursor Cells Express Low Levels of Telomerase in Vitro and Show Diminishing Cell Proliferation with Extensive Axonal Outgrowth following Transplantation" *Experimental Neurology* 164: 215-226.
Paterson, et al. 19985 "Microtubule-disrupting drugs increase the frequency of conversion of a rat mammary epithelial stem cell line to elongated, myoepithelial-like cells in culture" *J Cell Physiol.* 125(1): 135-150.
Pei 2009 "Regulation of pluripotency and reprogramming by transcription factors" *J Biol. Chem.* 284(6): 3365-3369.
Rieske, P. et al. 2005 "Human fibroblast-derived cell lines have characteristics of embryonic stem cells and cells of neuroectodermal origin" *Differentiation* 73: 474-483.
Sato, et al. 1991 "Early and late contraction induced by ouabain in human umbilical arteries" *Br J. Pharmacol* 102(2): 1525-1529.
Shea 1990 "Neurogenesis in mouse BD2a/d1 neuroblastoma cells: triggering by calcium influx and involvement of actin and tubulin dynamics" *Cell Biol Int Rep.* 14(11): 967-979.
Silva, et al. 2009 "Nanog is the getaway to pluripotent ground state" *Cell* 138(4): 722-737.
Singec, et al. 2009 "The leading edge of stem cell therapeutics" *Annu. Rev. Med* 58: 313-328.
Soldner, et al. 2009 "Parkinson's disease patient-derived induced pluripotent stem cells free of viral reprogramming factors" *Cell* 136(5): 964-977.
Takahashi, et al. 2007 "Induction of pluripotent stem cells from fibroblast cultures" *Nat. Protoc* 2: 3081-3089.
Takahashi, et al. 2006 "Induction of pluripotent stem cells from mouse embryonic and adult fibroblast cultures by defined factors" *Cell* 126(4): 663-676.
Takebyashi, et al. 1997 "Conversion of ectoderm into a neural fate by ATH-3, a vertebrate basic helix-loop gene homologous to *Drosophila* proneural gene atonal" *EMBO* 16(2): 384-395.
Tarnova, et al. 2006 "SOX2 is a dose-dependent regulator of retinal neural progenitor competence" *Genes Dev.* 20: 1187-1202.
Theise, et al. 2000 "Liver from bone marrow in humans" *Hepatology* 32(1): 11-6.
Uniprotkb-Q9GZX7 (AICDA_Human) downloaded on Dec. 19, 2015 from the World-Wide-Web at: uniprot.org/uniprot/Q9GZX7.
Vierbuchen, T. et al., "Direct conversion of fibroblasts to functional neurons by defined factors," Nature, Feb. 25, 2010, vol. 463, pp. 1035-1041.
Wang et al. 2008 "GADD45B inhibits MKK7-induced cardiac hypertrophy and the polymorphisms of GADD45B is associated with inter-ventricular septum hypertrophy" *Biochem Biophys Res Commun* 372(4): 623-628.
Warren, et al. 2010 "Highly efficient reprogramming to pluripotency and directed differentiation of human cells with synthetic modified mRNA" *Cell Stem Cell* 7(5): 618-630.
Wernig, M. et al. 2008 "Neurons derived from reprogrammed fibroblasts functionally integrate into the fetal brain and improve symptoms of rats with Parkinson's disease" *Proc Natl Acad Sci USA* 105: 5856-5861.
Wiese, C. et al. 2004 "Nestin expression—a property of multi-lineage progenitor cells?" *CMLS Cellular and Molecular Life Sciences* 61: 2510-2522.
Woltjen, et al. 2000 "Piggyback transposition reprograms fibroblasts to induced pluripotent stem cells" *Nature Letters* 458: 766-771.
Woodbury, et al. 2000 "Adult rat and human bone marrow stromal cells differentiate into neurons" *J Neurosci Res.* 61(4): 364-370.
Xu et al. (2007 "Histone deacetylase inhibitors: molecular mechanisms of action" *Oncogene* 26: 5541-5552.
Yeomans, et al. 1976 "Maturation and differentiation of cultured fetal stomach. Effects of corticosteroids, pentagastrin, and cytochalasin B" *Gastroenterology* 71(5): 770-777.
Yu, et al. 2007 "Induced pluripotent stem cell lines derived from human somatic cells" *Science* 318(5858): 1917-1920.
Yu, et al. 2009 "Human induced pluripotent stem cells free of vector and transgene sequences" *Science* 324(5928): 797-801.
Zhou, et al. 2009 "Generation of induced pluripotent stem cells using recombinant proteins" *Cell Stem Cell* 4: 381-384.
Zhou, et al. 2009 "Adenoviral gene delivery can reprogram human fibroblasts to induced pluripotent stem cells" *Stem Cells* 27(11): 2667-2674.
Zietlow, et al. 2008 "Human stem cells for CNS repair" *Cell Tissue Res.* 331: 301-322.
Hanna et al., "Pluripotency and Cellular Reprogramming: Facts, hypotheses, Unresolved Issues," Cell, Nov. 12, 2010, vol. 143, pp. 508-525.
Hochedlinger; and Plath 2009 "Epigenetic reprogramming and induced plutipotency" Development 136(4): 509-523.
Nishikawa et al., "The promise of human induced pluripotent stem cells for research and therapy" Stem Cells 9: pp. 725-729 (2008).
Ronaghi et al., "Challenges of stem cell therapy for spinal cord injury: Human embryonic stem cells, endogenous neutral stem cells, or induced pluripotent stem cells?" Stem Cells.
Simeonov; and Uppal 2014 "Direct reprogramming of human fibroblasts to hepatocyte-like cells by synthetic modified mRNAs" Plos One 9(6): 1-11.

\* cited by examiner

METHODS FOR REPROGRAMMING CELLS AND USES THEREOF

CROSS REFERENCE TO RELATED APPLICATIONS

This application is a continuation of U.S. application Ser. No. 14/958,791, filed Dec. 3, 2015, which is a continuation of U.S. application Ser. No. 13/843,713, filed Mar. 15, 2013, which is a continuation-in-part of U.S. application Ser. No. 13/464,987, filed May 5, 2012, which is a continuation-in-part of U.S. application Ser. No. 13/504,988, filed Apr. 30, 2012, which is the U.S. National Phase of International Application No. PCT/CA2010/001721, filed Nov. 1, 2010, which claims the benefit of U.S. Provisional Application No. 61/256,967, filed Oct. 31, 2009. The content of the aforesaid applications are relied upon and are incorporated by reference in their entireties

REFERENCE TO SEQUENCE LISTING

A Sequence Listing submitted as an ASCII text file via EFS-Web is hereby incorporated by reference in accordance with 35 U.S.C. § 1.52(e). The name of the ASCII text file for the Sequence Listing is 29001086_1.TXT, the date of creation of the ASCII text file is Sep. 7, 2018, and the size of the ASCII text file is 2.31 MB.

FIELD OF THE INVENTION

The present invention relates to the field of eukaryotic cell reprogramming, and particularly to cell dedifferentiation. The invention is also concerned with methods of generating stable Reprogrammed Cells and Stem-like Cells (SLCs), including Neural Stem-Like Cells (NSLCs) from human somatic cells (and other cells) and the use of the cells so generated in human therapy.

BACKGROUND OF THE INVENTION

Cell Reprogramming

There is a desire in the medical, scientific, and diagnostic fields to reprogram an easily obtainable cell into a cell that is generally harder to obtain, or to reprogram a cell to have new or different functionalities, without fusing or exchanging material with an oocyte or another stem cell.

Stem cells currently provide a promising venue to treat diseases or modulate/enhance certain functionalities. However, not all stem cells are the same and many challenges need to be overcome, for example:

(i) Embryonic and other pluripotent stem cells (ex. IPS cells) can turn into any type of cell which makes them very difficult to control and generally results in the wrong type of cell to grow in the wrong place, teratoma formation (a mass of cells containing different types of tissues) and tumors. Even when their differentiation and growth can be controlled, pluripotent stem cells will more likely grow a new competing tissue within the existing tissue rather than integrate into the existing damaged tissue.

(ii) Multipotent stem cells (somatic stem cells) are generally lineage-restricted stem cells that regenerate and grow existing tissues of their specific lineage (for example, neural stem cells regenerate and grow the nervous system, skin stem cells regenerate and grow skin, and hematopoietic stem cells regenerate and grow the hematopoietic tissue (blood cells). Somatic stem cells are the most effective when the right type of somatic stem cells is used for its corresponding tissue to be treated (for example, a hematopoietic or mesenchymal stem cell will have limited regenerative and growth abilities if implanted into the central nervous system (CNS), while neural stem cells are the types of somatic stem cells that have been evolved for this specific purpose and have significant regenerative and growth abilities in the CNS,).

(iii) For a stem cell to efficiently permanently graft (in a functional but not competitive manner) into the patient's tissue, the stem cell generally has to be autologous (the patient's own). The main exception to this is hematopoietic stem cell grafts (bone marrow transplants) due to the changes in the immune and other systems in the body caused by these specific somatic stem cells.

Thus there is a need for an efficient method to create safe and efficacious autologous stem cells for the specific tissue, organ or condition to be treated, as well as new types of stem cells with new or unique features such as enhanced potency and/or safety.

There are several current "non-reprogramming" mechanisms for obtaining a certain cell of interest. According to a first mechanism, a stem cell can naturally divide or differentiate into another stem cell, progenitor, precursor, or somatic cell. According to a second mechanism, a somatic cell can sometimes transiently change its phenotype or express certain markers when placed in certain conditions, and then revert back when placed back into the original conditions. According to a third mechanism, the phenotype of many cells can be changed through forced expression of certain genes (for example, stably transfecting the c-myc gene into fibroblasts turns them into immortal cells having neuroprogenitor characteristics), however once this forced gene expression is removed, the cells slowly revert back to their original state. Therefore, none of the three above mechanisms should be considered true reprogramming: the first is considered natural differentiation which is part of a cell program that is already in place (going from a more undifferentiated to a more differentiated state), the second is a transient phenotypical change, and the third is a constantly forced cell type. A true stem cell: (i) self-renews almost 'indefinitely' (for significantly longer than a somatic cell), (ii) is not a cancerous cell, (iii) is not artificially maintained by forced gene expression or similar means (must also be able to be maintained in standard stem cell media), (iv) can differentiate to progenitor, precursor, somatic or other more differentiated cell type (of the same lineage), and (v) has all the characteristics of a stem cell and not just certain markers or gene expression or morphological appearance.

Despite the numerous scientific and patent publications claiming successful reprogramming or dedifferentiation, generally into a stem cell, almost all of these publications do not disclose true reprogramming because they fall under one of the mechanisms mentioned above. For instance, Bhasin (WO2010/088735), Cifarelli et al. (US2010/0003223), Kremer et al. (US2004/0009595), and Winnier et al. (US2010/0047908) all refer to reprogramming, dedifferentiation, and/or obtained stem cells (or progenitors) as phenotypical cell changes based only on a change in cell surface markers after culture in different media with supplements, with no evidence of true reprogramming or an actual stem cell (non-cancerous self-renewal with stem cells markers and no differentiation markers). The same is true for Benneti (WO2009/079007) who used increased expression of Oct4 and Sox2. Others, such as Akamatsu et al. (WO2010/

052904) and You et al. (WO2007/097494, US2009/0246870), refer to having made stem cells, but these came about through constant artificial gene induction delivered by retrovirus (similar to cMyc) with no evidence of true stem cells that are not immortal/tumorigenic, and stable instead of transient. Others, such as Chen at al. (US2005/0176707) and You et al. (US2009/0227023), have made "multipotent cells", but not stem cells. In addition these alleged multipotent cells were not stable (in the case of You et al. the cells could not even proliferate) and both used constant media supplements and conditions to force the phenotypical change. Yet others, such as Oliveri et al. (WO2009/018832) and Zahner at al. (US2002/0136709), have claimed the making of pluripotent, totipotent, multipotent, and/or unipotent cells automatically through genome-wide DNA demethylation and histone acetylation, but with no evidence of a stable, non-cancerous, true cell line.

True reprogramming appears to have been achieved with induced pluripotent stem cells (iPS cells) created independently by Yamanaka's group (Takahashi et al., 2007) and Thomson's group (Yu at al., 2007), and potentially by others before them, and although many of these cells were later found to be cancerous, some of them were not. These cells can be induced by true reprogramming since it was later shown that they can also be induced by non-gene integrating transient transfection (Soldner at al., 2009; Woldtjen et al., 2009; Yu et al., 2009) as well as by RNA (Warren et al., 2010) or protein (Kim et al., 2009; Zhou at al., 2009) alone or by small molecules (Lyssiotis et al., 2009), and by similar methods. However, these cells are essentially identical to embryonic stem cells and have the same problems of uncontrolled growth, teratoma formation, and potential tumor formation. In addition they appear to be less potent and less safe than embryonic stem cells, including the differentiated cells (including multipotent/somatic stem cells) derived using this iPS method.

A more desirable option is to have multipotent stem cells or pluripotent-like cells whose lineage and differentiation potential is more restricted so that they do not readily form teratomas and uncontrolled growth. There is thus a need for methods of creating multipotent stem cells, multipotent stem-like cells, and stem-like cells and method of reprogramming or transforming easily obtainable cells to highly desirable multipotent stem cells, multipotent stem-like cells, and stem-like cells.

Neural Stem-Like Cells (NSLC)

Repairing the central nervous system (CNS) is one of the frontiers that medical science has yet to conquer. Conditions such as Alzheimer's disease, Parkinson's disease, and stroke can have devastating consequences for those who are afflicted. A central hope for these conditions is to develop cell populations that can reconstitute the neural network, and bring the functions of the nervous system back in line. For this reason, there is a great deal of evolving interest in neural stem and progenitor cells. Up until the present time, it was generally thought that multipotent neural progenitor cells commit early in the differentiation pathway to either neural restricted cells or glia restricted cells.

Neural stem cells have promise for tissue regeneration from disease or injury; however, such therapies will require precise control over cell function to create the necessary cell types. There is not yet a complete understanding of the mechanisms that regulate cell proliferation and differentiation, and it is thus difficult to fully explore the plasticity of neural stem cell population derived from any given region of the brain or developing fetus.

The CNS, traditionally believed to have limited regenerative capabilities, retains a limited number of neural stem cells in adulthood, particularly in the dentate gyrus of the hippocampus and the subventricular zone that replenishes olfactory bulb neurons (Singec I et al., 2007; Zielton R, 2008). The availability of precursor cells is a key prerequisite for a transplant-based repair of defects in the mature nervous system. Thus, donor cells for neural transplants are largely derived from the fetal brain. This creates enormous ethical problems, in addition to immuno-rejection, and it is questionable whether such an approach can be used for the treatment of a large number of patients since neural stem cells can lose some of their potency with each cell division.

Neural stem cells provide promising therapeutic potential for cell-replacement therapies in neurodegenerative disease (Mimeaultt et al., 2007). To date, numerous therapeutic transplantations have been performed exploiting various types of human fetal tissue as the source of donor material. However, ethical and practical considerations and their inaccessibility limit the availability as a cell source for transplantation therapies (Ninomiy M et al., 2006).

To overcome barriers and limitations to the derivation of patient specific cells, one approach has been to use skin cells and inducing the trans-differentiation to neural stem cells and/or to neurons (Levesque et al., 2000). Transdifferentiation has been receiving increasing attention during the past years, and trans-differentiation of mammalian cells has been achieved in co-culture or by manipulation of cell culture conditions. Alteration of cell fate can be induced artificially in vitro by treatment of cell cultures with microfilament inhibitors (Shea et al., 1990), hormones (Yeomans et al., 1976), and Calcium-ionophores (Shea, 1990; Sato et al., 1991). Mammalian epithelial cells can be induced to acquire muscle-like shape and function (Paterson and Rudland, 1985), pancreatic exocrine duct cells can acquire an insulin-secreting endocrine phenotype (Bouwens, 1998a, b), and bone marrow stem cells can be differentiated into liver cells (Theses at al., 2000) and into neuronal cells (Woodbury et al., 2000). Other such as Page at al. (US 2003/0059939) have transdifferentiated somatic cells to neuronal cells by culturing somatic cells in the presence of cytoskeletal, acetylation, and methylation inhibitors, but after withdrawal of the priming agent, neuron morphology and established synapses last for not much than a few weeks in vitro, and complete conversion to a fully functional and stable type of neuron has never been demonstrated. These are thus transient cell phenotypes. Complete conversion to a fully functional and stable type of neuroprogenitor or neural stem cell has also never been demonstrated. Acquisition of a stable phenotype following transdifferentiation has been one of the major challenges facing the field.

Thus, there is a need in the biomedical field for stable, potent, and preferably autologous neural stem cells, neural progenitor cells, as well as neurons and glial cells for use in the treatment of various neurological disorders and diseases. The same is true for many other types of cells. Recently, evidence have been obtained that genes of the basic Helix-Loop-Helix (bHLH) class are important regulators of several steps in neural lineage development, and over-expression of several neurogenic bHLH factors results in conversion of non-determined ectoderm into neuronal tissue. Proneural bHLH proteins control the differentiation into progenitor cells and their progression through the neurogenic program throughout the nervous system (Bertrand et al., 2002). MASH1, NeuroD, NeuroD2, MATH1-3, and Neurogenin 1-3 are bHLH transcription factors expressed during mammalian neuronal determination and differentiation (Johnson et al., 1990; Takebyashi at al., 1997; McCormick et al., 1996; Akazawa at al., 1995). Targeted disruptions of MASH1, Ngn1, Ngn2 or NeuroD in mice lead to the loss of specific subsets of neurons (Guillemot et al., 1993; Fode at al., 1998; Miyata et al., 1999).

U.S. Pat. No. 6,087,168 (Levesque at al.,) describes a method for converting or transdifferentiating epidermal basal cells into viable neurons. In one example, this method comprises the transfection of the epidermal cells with one or more expression vector(s) containing at least one cDNA encoding for a neurogenic transcription factor responsible for neural differentiation. Suitable cDNAs include: basic-helix-loop-helix activators, such as NeuroD1, NeuroD2, ASH1, and zinc-finger type activators, such as Zic3, and MyT1. The transfection step was followed by adding at least one antisense oligonucleotide known to suppress neuronal differentiation to the growth medium, such as the human MSX1 gene and/or the human HES1 gene (or non-human, homologous counterparts). Finally, the transfected cells were grown in the presence of a retinoid and a least one neurotrophin or cytokine, such as brain derived neurotrophic factor (BDNF), nerve growth factor (NGF), neurotrophin 3 (NT-3), or neurotrophin 4 (NT-4). This technology yields 26% of neuronal cells; however, neither functionality nor stability of these cells was established. In addition, neural stem cells or neuroprogenitor cells are not produced according to this method.

A later process (Levesque et al., 2005; U.S. Pat. No. 6,949,380) mentions the conversion of the epidermal basal cell into a neural progenitor, neuronal, or glial cell by exposing the epidermal basal cell to an antagonist of bone morphogenetic protein (BMP) and growing the cell in the presence of at least one antisense oligonucleotide comprising a segment of a MSX 1 gene and/or HES1 gene. However, there is no evidence or examples that any neural progenitors or glial cells were produced according to this method, let alone any details or evidence that morphological, physiological or immunological features of neuronal cells was achieved. In addition, since there is also no information on functionality, stability, expansion, and yield about the cells which may or may not have been produced, it is possible that these cells actually are skin-derived precursor cells (Fernandes at al., 2004) that have been differentiated into neuronal cells.

In view of the above, there is thus a need for stable, potent, and preferably autologous neural stem cells, neural progenitor cells, neurons and glial cells, as well as other types of cells, stem cells and progenitor cells. There is also a need for methods that could result in true cell dedifferentiation and cell reprogramming.

The present invention addresses these needs and provides various types of stem-like and progenitor-like cells and cells derived or differentiated from these stem-like or progenitor-like cells, as well as methods that can result in true cell dedifferentiation and cell reprogramming.

Additional features of the invention will be apparent from a review of the disclosure and description of the invention herein.

SUMMARY OF THE INVENTION

The present invention relates to stem-like and progenitor-like cells and cells derived or differentiated from these stem-like or progenitor-like cells. The invention further relates to methods for cell dedifferentiation and cell reprogramming. The invention further features compositions and methods that are useful for reprogramming cells and related therapeutic compositions and methods.

One particular aspect relates to the development of a technology to reprogram a somatic cell or non-neuronal cell to a cell having one or more morphological physiological, and/or immunological features of a neural stem cell and which possess the capacity to differentiate along neuronal and glial lineages. According to some embodiments, the invention is more particularly concerned with methods of generating stable Neural Stem-Like Cells (NSLCs) from human somatic cells, human progenitor cells and/or of human stem cells, as well as cells, cell lines and tissues obtained by using such methods.

The invention further relates to compositions and methods to induce de-differentiation of human somatic cells into Neural Stem-Like Cells that express neural stem cell specific markers. According to the present invention it is possible to effect the conversion of cells to various types of differentiated neuronal cells that can be created from a single cell type taken from an individual donor and then reprogrammed and transplanted into the same individual. Upon induction cells according to the invention express neural stem-cell specific markers and become Neural Stem-Like cells.

Other particular aspects relate to the development of technologies to reprogram a somatic cell to a cell having one or more morphological physiological, and/or immunological features of a cardiac stem cell, hematopoietic stem cell, pancreatic progenitor cell, myogenic (muscle) stem cell, pluripotent stem cell, ectodermal derived cell and/or mesendodermal derived cell and which possess the capacity to differentiate along their respective lineages. According to some embodiments, the invention is more particularly concerned with methods of generating stable Cardiac Stem-Like Cells (CSLCs), Hematopoietic Stem-Like Cells (HSLCs), Pancreatic Progenitor-Like Cells, Myogenic (muscle) Stem-Like Cells, Pluripotent-Like Cells, Ectoderm-Like Cells and Mesendoderm-Like Cells from human somatic cells, human progenitor cells and/or of human stem cells, as well as cells, cell lines and tissues obtained by using such methods.

The invention further relates to compositions and methods to induce de-differentiation of human somatic cells into Cardiac Stem-Like Cells (CSLCs), Hematopoietic Stem-Like Cells (HSLCs), Pancreatic Progenitor-Like Cells, Myogenic (muscle) Stem-Like Cells, Pluripotent-Like Cells, Ectoderm-Like Cells and Mesendoderm-Like Cells that express cardiac stem cell, hematopoietic stem cell, pancreatic progenitor cell, myogenic (muscle) stem cell, pluripotent stem cell, ectoderm cell and mesendoderm cell specific markers, respectively. According to the present invention it is possible to effect the conversion of cells to various types of differentiated cardiac, hematopoietic (blood), pancreatic, myogenic (muscle), pluripotent derived, ectoderm derived and/or mesendoderm derived cells that can be created from a single cell type taken from an individual donor and then reprogrammed and transplanted into the same individual.

According to one particular aspect, the invention relates to a method of transforming a cell of a first type to a desired cell of a different type. This comprises i) obtaining a cell of a first type; ii) transiently increasing in the cell of a first type intracellular levels of at least one reprogramming agent, whereby the transient increase induces direct or indirect endogenous expression of at least one gene regulator; iii) placing the cell in conditions for supporting the growth and/or the transformation of the desired cell and maintaining intracellular levels of the at least one reprogramming agent for a sufficient period of time to allow stable expression of the at least one gene regulator in the absence of the reprogramming agent; and iv) maintaining the cell in culture conditions supporting the growth and/or the transformation of the desired cell. Such conditions are maintained for a sufficient period of time to allow a stable expression of a plurality of secondary genes. According to the invention the expression of one or more of the secondary genes is characteristic of phenotypical and functional properties of the desired cell while being not characteristic of phenotypical and functional properties of an embryonic stem cell. Therefore, at the end of the period of time, the desired cell of a different type is obtained.

According to another particular aspect, the invention relates to a method of transforming a cell of a first type to a cell of a second different type. The method comprises contacting the cell of a first type with one or more agents capable of increasing within said cell levels of at least one reprogramming agent and directly or indirectly remodeling the chromatin and/or DNA of the cell. The at least one reprogramming agent is selected for inducing directly or indirectly the expression of morphological and functional characteristics of a desired cell of a different type or different cell lineage.

According to another aspect, the invention relates to a method of transforming a cell of a first type to a cell of a second different type. The method comprises contacting the chromatin and/or DNA of a cell of a first type with an agent capable of remodeling chromatin and/or DNA of said cell; and increasing intracellular levels of at least one reprogramming agent. The at least one reprogramming agent is selected for inducing directly or indirectly the expression of morphological and functional characteristics of a desired cell of a different type or cell lineage.

A further aspect of the invention relates to a method of transforming a cell of a first type to a cell of a desired cell of a different type, comprising increasing intracellular levels of at least one reprogramming agent, wherein the at least one reprogramming agent is selected for inducing directly or indirectly the expression of morphological and functional characteristics of a desired second cell type; and maintaining the cell of a first type in culture conditions for supporting the transformation of the desired cell for a sufficient period of time to allow stable expression of a plurality of secondary genes whose expression is characteristic of phenotypical and functional properties of the desired cell, wherein at least one of the secondary genes is not characteristic of phenotypical and functional properties of an embryonic stem cell. At the end of the period of time the desired cell of a different type is obtained and the obtained cell is further characterized by a stable repression of a plurality of genes expressed in the first cell type.

A further aspect of the invention concerns a process wherein a cell of a first type is reprogrammed to a desired cell of a different type, the process comprising:
a transient increase of intracellular levels of at least one reprogramming agent, wherein the at least one reprogramming agent induces a direct or indirect endogenous expression of at least one gene regulator, and wherein the endogenous expression of the said at least one gene regulator is necessary for the existence of the desired cell of a different type;
a stable expression of said at least one gene regulator;
stable expression of a plurality of secondary genes, wherein the stable expression of the secondary genes is the result of the stable expression of the at least one gene regulator, and wherein: (i) stable expression of the plurality of secondary genes is characteristic of phenotypical and/or functional properties of the desired cell, (ii) stable expression of at least one of said secondary genes is not characteristic of phenotypical and functional properties of an embryonic stem cell, and wherein (i) and (ii) are indicative of successful reprogramming of the cell of the first type to the desired cell of the different type.

In particular embodiments, the at least one reprogramming agent is a polypeptide listed in Table A. In additional embodiments the at least one gene regulator may be one or more of the genes listed in Table A for the desired cell type (desired cell of a second different type).

In particular embodiments, the at least one reprogramming agent in the process is a Msi1 polypeptide, or a Ngn2 polypeptide together with a MDB2 polypeptide. In particular embodiments, the at least one gene regulator is Sox2 Msi1, or both. In additional embodiments the at least one gene regulator may is one or more of the genes listed in Table A for Neural Stem-Like Cells.

According to another aspect, the invention relates to a method of obtaining a Stem-Like Cell (SLC), comprising:
i) providing a cell of a first type;
ii) transiently increasing in the cell intracellular levels of at least one reprogramming agent, whereby the transient increase induces direct or indirect endogenous expression of at least one gene regulator
iii) placing the cell in conditions for supporting the transformation into the stem-like cell and maintaining intracellular levels of the at least one reprogramming agent for a sufficient period of time to allow stable expression of the at least one gene regulator in absence of the reprogramming agent;
iv) maintaining the cell in culture conditions for supporting the transformation into the stem-like cell for a sufficient period of time to allow stable expression of a plurality of 6 secondary genes whose expression is characteristic of phenotypical and/or functional properties of the stem-like cell, wherein at least one of the secondary genes is not characteristic of phenotypical and functional properties of an embryonic stem cell. At the end of said period of time a stem-like cell is obtained.

A Stem-Like Cell (SLC) can be any type of stem-like cell such as a Neural Stem-Like Cell, Cardiac Stem-Like Cell (CSLCs), Hematopoietic Stem-Like Cell (HSLCs), Pancreatic Progenitor-Like Cell, Myogenic (muscle) Stem-Like Cell, Pluripotent-Like Cell, Ectoderm-Like Cell or Mesendoderm-Like Cell.

According to another aspect, the invention relates to a method of obtaining a Stem-Like Cell. The method comprises increasing intracellular levels of at least one polypeptide specific to the desired stem cell type that is able to drive directly or indirectly transformation of the cell of the first type into the Stem-Like Cell. For increasing the yield or type of Stem-Like Cell, the method may further comprises contacting chromatin and/or DNA of a cell of a first type with a histone acetylator, an inhibitor of histone deacetylation, a DNA demethylator, and/or an inhibitor of DNA methylation; and/or increasing intracellular levels of at least one other polypeptide specific to the desired stem cell type that is able to drive directly or indirectly transformation of the cell of the first type into a Stem-Like Cell.

According to another aspect, the invention relates to a method of obtaining a Stem-Like Cell comprising the use of one or more compounds that increase intracellular levels of at least one polypeptide specific to the desired stem cell type that is able to drive directly or indirectly transformation of the cell of the first type into the Stem-Like Cell. For increasing the yield or type of Stem-Like Cell, the method may further comprises contacting chromatin and/or DNA of a cell of a first type with a histone acetylator, an inhibitor of histone deacetylation, a DNA demethylator, and/or an inhibitor of DNA methylation; and/or increasing intracellular levels of at least one other polypeptide specific to the desired stem cell type that is able to drive directly or indirectly transformation of the cell of the first type into a Stem-Like Cell; and/or disrupting the cell cytoskeleton or cell integrity with at least one cytoskeleton disruptor.

According to another aspect, the invention relates to a method of obtaining a Neural Stem-Like Cell (NSLC). The method comprises increasing intracellular levels of at least one neural stem cell specific polypeptide that is able to drive directly or indirectly transformation of the cell of the first type into a NSLC. For increasing the yield or type of NSLC, the method further comprises contacting chromatin and/or DNA of a cell of a first type with a histone acetylator, an inhibitor of histone deacetylation, a DNA demethylator, and/or an inhibitor of DNA methylation; and/or increasing intracellular levels of at least one other neural stem cell specific polypeptide 6 that is able to drive directly or indirectly transformation of the cell of the first type into a NSLC.

Another aspect of the invention concerns a method of obtaining a Neural Stem-Like Cell (NSLC). In one embodiment the method comprises transfecting a skin cell with a polynucleotide encoding Musashi1, Musashi1 and Neurogenin 2, Musashi1 and Methyl-CpG Binding Domain Protein 2 (MBD2), or Neurogenin 2 and Methyl-CpG Binding Domain Protein 2, thereby reprogramming the skin cell into a NSLC. In another embodiment the method comprises exposing a skin cell to: (i) an inhibitor of histone deacetylation, (ii) an inhibitor of DNA methylation, (Iii) a histone acetylator, and/or (iv) a DNA demethylator such as a MBD2 polypeptide and/or transfecting with a polynucleotide encoding a MBD2 polypeptide; and further transfecting the cell (either simultaneously, before, or afterwards) with a polynucleotide encoding MUSASHI1 and/or with a polynucleotide encoding NGN2, thereby reprogramming the skin cell into a NSLC. Some other cells, such as keratinocytes and CD34+ cells, can also be used and reprogrammed. Additionally introducing into the cells one or more of the following polypeptides (ex. by transfection of their corresponding polynucleotides) reprograms the cells to Ectoderm-Like Cells: Zinc Finger Protein 42 (REX1), Octamer-binding Transcription Factor 4 (OCT4), Kruppel-like Factor 4 (KLF4), Sal-like 4 (SALL4), and Nanog Homeobox (NANOG), Another aspect of the invention concerns a method of obtaining a Cardiac Stem-Like Cell (CSLC). In one embodiment the method comprises transfecting a mesenchymal stem cell with a polynucleotide encoding Brachyury (T) and Mesoderm Posterior 1 (MESP1), along with NK2 Homeobox 5 (Nkx2.5) and/or T-box 5 (TBX5), thereby reprogramming the mesenchymal stem cell into a CSLC. In another embodiment the method comprises exposing a mesenchymal stem cell to compounds that result in histone acetylation and/or DNA demethylation, and further transfecting the cell (either simultaneously, before, or afterwards) with polynucleotides encoding Brachyury (T) and Mesoderm Posterior 1 (MESP1), along with NK2 Homeobox 5 (Nkx2.5) and/or T-box 5 (TBX5), thereby reprogramming the mesenchymal stem cell into a CSLC.

Another aspect of the invention concerns a method of obtaining a Hematopoietic Stem-Like Cell (HSLC). In one embodiment the method comprises transfecting an adipocyte-derived stem cell with a combination of polynucleotides encoding Brachyury (T), Caudal Type Homeobox 4 (CDX4), Homeobox B4 (HOXB4), GATA Binding Factor 1 (GATA1), GATA Binding Factor 2 (GATA2), and/or Kruppel-like Factor 1 (KLF1), thereby reprogramming the cell into a HSLC. In another embodiment the method comprises exposing an adipocyte-derived stem cell to compounds that result in histone acetylation and/or DNA demethylation, and further transfecting the cell (either simultaneously, before, or afterwards) with a combination of polynucleotides encoding Brachyury (T), Caudal Type Homeobox 4 (CDX4), Homeobox B4 (HOXB4), GATA Binding Factor 1 (GATA1), GATA Binding Factor 2 (GATA2), and/or Kruppel-like Factor 1 (KLF1), thereby reprogramming the cell into a HSLC.

Another aspect of the invention concerns a method of obtaining a Pancreatic Progenitor-Like Cell. In one embodiment the method comprises transfecting an adipocyte-derived stem cell with a polynucleotide encoding SRY (Sex determining Region Y)-box 17 (SOX17), Pancreatic and Duodenal Homebox 1 (PDX1) and Neurogenin 3 (NGN3) optionally along with Octamer-binding Transcription Factor 4 (OCT4), thereby reprogramming the cell into a Pancreatic Progenitor-Like Cell. In another embodiment the method comprises exposing an adipocyte-derived stem cell to compounds that result in histone acetylation and/or DNA demethylation; and further transfecting the cell (either simultaneously, before, or afterwards) with polynucleotides encoding SRY (Sex determining Region Y)-box 17 (SOX17), Pancreatic and Duodenal Homebox 1 (PDX1) and Neurogenin 3 (NGN3) optionally along with Octamer-binding Transcription Factor 4 (OCT4), thereby reprogramming the cell into a Pancreatic Progenitor-Like Cell.

Another aspect of the invention concerns a method of obtaining a Mesendoderm-Like Cell. In one embodiment the method comprises transfecting an adipocyte-derived stem cell with a polynucleotide encoding Forkhead Box D3 (FOXD3), MIX1 Homeobox-Like Protein 1 (MIXL1) and Neurogenin 3 (NGN3) along with Methyl-CpG Binding Domain Protein 2 (MBD2), thereby reprogramming the cell into a Mesendoderm-Like Cell. In another embodiment the method comprises exposing an adipocyte-derived stem cell to compounds that result in histone acetylation and/or DNA demethylation; and further transfecting the cell (either simultaneously, before, or afterwards) with polynucleotides encoding Forkhead Box D3 (FOXD3), MIX1 Homeobox-Like Protein 1 (MIXL1) and Neurogenin 3 (NGN3), thereby reprogramming the cell into a Mesendoderm-Like Cell.

Another aspect of the invention concerns a method of obtaining a Pluripotent-Like Cell. In one embodiment the method comprises transfecting an adipocyte-derived stem cell with a polynucleotide encoding a) Zinc Finger Protein 42 (REX1), Octamer-binding Transcription Factor 4 (OCT4) and Kruppel-like Factor 4 (KLF4), or b) Sal-like 4 (SALL4), Octamer-binding Transcription Factor 4 (OCT4), Kruppel-like Factor 4 (KLF4) and Nanog Homeobox (NANOG), thereby reprogramming the cell into a Pluripotent-Like Cell. In another embodiment the method comprises exposing an adipocyte-derived stem cell to compounds that result in histone acetylation and/or DNA demethylation; and further transfecting the cell (either simultaneously, before, or afterwards) with polynucleotides encoding a) Zinc Finger Protein 42 (REX1), Octamer-binding Transcription Factor 4 (OCT4) and Kruppel-like Factor 4 (KLF4), or b) Sal-like 4 (SALL4), Octamer-binding Transcription Factor 4 (OCT4), Kruppel-like Factor 4 (KLF4) and Nanog Homeobox (NANOG), thereby reprogramming the cell into a Pluripotent-Like Cell.

In one particular embodiment, the method of obtaining a Neural Stem-Like Cell (NSLC), comprises:
providing a cell of a first type;
introducing into the cell one or more polynucleotide capable of transient expression of one or more the following polypeptides: Musashi1 (Msi1); a Musashi1 (Msi1) and a Neurogenin 2 (Ngn2); a Musashi1 (Msi1) and methyl-CpG binding domain protein 2 (MBD2); and Neurogenin 2 (Ngn2) and methyl-CpG binding domain protein 2 (MBD2); and
placing the cell in culture conditions supporting the transformation into a NSLC for a sufficient period of time to allow a stable expression of a plurality of genes whose expression is characteristic of phenotypical and functional properties of a NSLC.

At the end of the period of time a NSLC is obtained and the obtained NSLC is further characterized by a stable repression of a plurality of genes expressed in the first cell type.

According to another embodiment, the method of obtaining a Neural Stem-Like Cell (NSLC), comprises:
providing a cell of a first type which is not a NSLC;
increasing intracellular levels of at least one neural stem cell specific polypeptide, wherein the polypeptide is capable of driving directly or indirectly transformation of the cell of the first type into a NSLC; and
contacting the chromatin and/or DNA of the cell of a first type with a histone acetylator, an inhibitor of histone deacetylation, a DNA demethylator, and/or a chemical inhibitor of DNA methylation.

According to another embodiment, the method of obtaining a Neural Stem-Like Cell (NSLC), comprises:
obtaining a non-NSLC;
co-transfecting the non-NSLC with a first polynucleotide encoding a MBD2 polypeptide and with at least one second polynucleotide encoding a MUSASHI1 polypeptide and/or encoding a NGN2 polypeptide;
placing the co-transfected cell in culture conditions for supporting the transformation of NSLC until said NSLC is obtained.

Certain aspects of the invention concerns isolated cells, cell lines, compositions, 3D assembly of cells, and tissues comprising cells obtained using the methods described herein. Additional aspects concerns the use of such isolated cells, cell lines, compositions, 3D assembly of cells, and tissues of medical treatment and methods of regenerating a mammalian tissue or organ.

Yet, a further aspect concerns a method for repairing or regenerating a tissue in a subject. In one embodiment the method comprises the administration of a reprogrammed cell as defined herein to a subject in need thereof, wherein the administration provides a dose of reprogrammed cells sufficient to increase or support a biological function of a given tissue or organ, thereby ameliorating the subject's condition. In another embodiment the method comprises the administration of a reprogrammed cell that has been genetically modified (for therapeutic or other purposes) or genetically corrected (in cases of a genetic disease or similar Instance) to a subject in need thereof, wherein the administration provides a dose of reprogrammed genetically-modified/-corrected cells sufficient to increase, support, replace or correct a biological function of a given cell, tissue or organ, thereby ameliorating or correcting the subject's condition or allowing for a desired condition.

The benefits of the present invention are significant and include more potent and/or safer and/or lower cost of cell therapy by eliminating the need of immuno-suppressive agents, no need for embryos or fetal tissue, thus eliminating ethical and time constraints, lower cost of production, and no health risks due to possible transmission of viruses or other disease, and the availability of more potent and/or safer stem-like cells and progenitor-like cells. In addition, since the cells are created fresh, they tend to be more potent than cells that have been passaged multiple times.

Additional aspects, advantages and features of the present invention will become more apparent upon reading of the following non-restrictive description of preferred embodiments and Examples which are exemplary and should not be interpreted as limiting the scope of the invention.

DETAILED DESCRIPTION OF THE INVENTION

The present invention relates to reprogrammed cells, methods for cell dedifferentiation and cell reprogramming, and use of these cells. A significant aspect of the present invention is that it permits the use of a patient's own cells to develop different types of cells either in situ (in the patient) or that can be transplanted after steps of in vitro dedifferentiation and in vitro reprogramming. Thus, this technology eliminates the problems associated with a) lack of the patient's own desired cells; b) lack of potency or other desired functional features of the patient's own desired cells; and/or c) problems associated with transplantation of non-host cells, such as, immunological rejection and the risk of transmitting disease, and no permanent functional grafting. In addition, since the cells are "newly created", they have the potential to be more potent than alternative sources of natural cells that have already divided multiple times.

Definitions

As used herein and in the appended claims, the singular forms "a," "an", and "the", include plural referents unless the context clearly indicates otherwise. Thus, for example, reference to "a cell" includes one or more of such cells or a cell line derived from such a cell, reference to "an agent" includes one or more of such agent, and reference to "the method" Includes reference to equivalent steps and methods known to those of ordinary skill in the art that could be modified or substituted for the methods described herein.

As used herein, the term "polynucleotide" refers to any DNA or RNA sequence or molecule, comprising encoding nucleotide sequences. The term is intended to encompass all polynucleotides whether occurring naturally or non-naturally in a particular cell, tissue or organism. This includes DNA and fragments thereof, RNA and fragments thereof, cDNAs and fragments thereof, expressed sequence tags, artificial sequences including randomized artificial sequences.

As used herein, the term "polypeptide" refers to any amino acid sequence having a desired functional biological activity (e.g. DNA demethylation). The term is intended to encompass complete proteins, fragments thereof, fusion proteins and the like, including carbohydrate or lipid chains or compositions.

"Trans-differentiation" refers to a direct switch of an already differentiated cell to another type of differentiated cell.

"De-differentiation" refers to the loss of phenotypic characteristics of a differentiated cell by activating or deactivating genes or metabolic pathways.

"Marker" refers to a gene, polypeptide, or biological function that is characteristic of a particular cell type or cellular phenotype.

"Genetically-engineered DNA sequence" is meant a DNA sequence wherein the component sequence elements of DNA sequence are organized within the DNA sequence in a manner not found in nature.

"Signal sequence" refers to a nucleic acid sequence which, when incorporated into a nucleic acid sequence encoding a polypeptide, directs secretion of the translated polypeptide from cells which express said polypeptide, or allows the polypeptide to readily cross the cell membrane into a cell. The signal sequence is preferably located at the 5' end of the nucleic acid sequence encoding the polypeptide, such that the polypeptide sequence encoded by the signal sequence is located at the N-terminus of the translated polypeptide. By "signal peptide" is meant the peptide sequence resulting from translation of a signal sequence.

"Ubiquitous promoter" refers to a promoter that drives expression of a polypeptide or peptides encoded by nucleic acid sequences to which promoter is operably linked. Preferred ubiquitous promoters include human cytomegalovirus immediate early (CMV); simian virus 40 early promoter (SV40); Rous sarcoma virus (RSV); or adenovirus major late promoter.

"Gene expression profiling" means an assay that measures the activity of multiple genes at once, creating a global picture of cellular function. For example, these profiles can distinguish between human neural stem cells and somatic cells that are actively dividing or differentiating.

"Transfection" refers to a method of gene delivery that introduces a foreign nucleotide sequences (e.g. DNA molecules) into a cell preferably by a non-viral method. In preferred embodiments according to the present invention foreign DNA is introduced to a cell by transient transfection of an expression vector encoding a polypeptide of interest, whereby the foreign DNA is introduced but eliminated over time by the cell and during mitosis. By "transient transfection" is meant a method where the introduced expression vectors and the polypeptide encoded by the vector, are not permanently integrated into the genome of the host cell, or anywhere in the cell, and therefore may be eliminated from the host cell or its progeny over time. Proteins, polypeptides, or other compounds can also be delivered into a cell using transfection methods.

"Neuroprogenitor Cell" refers to an immature cell of the nervous system, which can differentiate into neurons and glia (oligodendrocytes and astrocytes). "Neural Stem Cell" is an ectoderm germ layer derived multipotent stem cell having, as a physiological feature, a capacity to form neuroprogenitor cells and under physiological conditions that favor differentiation to form neurons and glia. "Neural Stem-Like Cell" or "NSLC" refers to any cell-derived multipotent stem cell having, as a physiological feature, a capacity to form other neural stem-like cells and neuroprogenitor-like cells and under physiological conditions that favor differentiation to form neuron-like cells and glial-like cells.

"Neurosphere" refers to a cellular aggregate of neural stem cells and neuroprogenitor cells that form a floating sphere formed as a result of proliferation of the neural stem cells and neuroprogenitor cells in appropriate proliferation conditions. NSLCs also form neurospheres consisting of aggregates of NSLCs and neuroprogenitor-like cells.

"Cardiosphere" refers to a cellular aggregate of cardiac stem cells and cardiac progenitor cells that form a floating sphere formed as a result of proliferation of the cardiac stem cells and cardiac progenitor cells in appropriate proliferation conditions. CSLCs also form cardiospheres consisting of aggregates of CSLCs and cardiac progenitor-like cells.

"Reprogrammed cell" refers to a cell that has undergone stable trans-differentiation, de-differentiation, or transformation. Some reprogrammed cells can be subsequently induced to re-differentiate. The reprogrammed cell stably expresses a cell-specific marker or set of markers, morphology, and/or biological function that was not characteristic of the original cell. "Reprogrammed somatic cell" refers to a process that alters or reverses the differentiation status of a somatic cell, which can be either complete or partial conversion of the differentiated state to an either less differentiated state or a new differentiated state.

"Regeneration" refers to the capability of contributing to the repair or de novo construction of a cell, tissue or organ.

"Differentiation" refers to the developmental process of lineage commitment of a cell. Differentiation can be assayed by measuring an increase in one or more cell-differentiation specific markers relative to the expression of the undifferentiated cell markers.

"Lineage" refers to a pathway of cellular development, in which a more undifferentiated cell undergoes progressive physiological changes to become a more differentiated cell type having a characteristic function (e.g., neurons and glia are of a neuroprogenitor lineage, which is of an ectoderm lineage which formed from blastocysts and embryonic stem (ES) cells).

"Tissue" refers to an ensemble of cells (Identical or not) and an extracellular matrix (ECM) that together carry out a specific function or set of functions.

"CDM" is meant a living tissue equivalent or matrix, a living scaffold, or cell-derived matrix.

Cell Transformation

Some aspects of the invention concerns methods and cells to transform or reprogram a given somatic cell into a pluripotent, multipotent and/or unipotent cell. Some aspects of the invention relates to methods for conditioning a somatic cell to reprogramming into a pluripotent, multipotent or unipotent cell.

The terms "transform" or "reprogram" are used interchangeably to refer to the phenomenon in which a cell is dedifferentiated or transdifferentiated to become pluripotent, multipotent and/or unipotent. The dedifferentiated cell could subsequently be redifferentiated into a different type of cell. Cells can be reprogrammed or converted to varying degrees. For example, it is possible that only a small portion of cells are converted or that an individual cell is reprogrammed to be multipotent but not necessarily pluripotent. Thus, the terms "transforming" or "reprogramming" methods can refer to methods wherein it is possible to reprogram a cell such that the "new" cell shows morphological and functional characteristics of a new or different specific cell lineage (e.g. the transformation of fibroblast cells into neuronal cells).

As used herein, the term "somatic cell" refers to any differentiated cell forming the body of an organism, apart from stem cells, progenitor cells, and germline cells (i.e. ovogonies and spermatogonies) and the cells derived therefrom (e.g. oocyte, spermatozoa). For instance, internal organs, skin, bones, blood, and connective tissue are all made up of somatic cells. Somatic cells according to the invention can be differentiated cells isolated from adult or can be fetal somatic cells. Somatic cells are obtained from animals, preferably human subjects, and cultured according to standard cell culture protocols available to those of ordinary skill in the art.

As used herein, "Stem cell" refers to those cells which retain the ability to renew themselves through mitotic cell division and which can differentiate into a diverse range of specialized cell types. It includes both embryonic stem cells that are found in blastocysts, and adult stem cells that are found in adult tissues. "Totipotent cells" refers to cells that have the ability to develop into cells derived from all three embryonic germ layers (mesoderm, endoderm and ectoderm) and an entire organism (e.g., human being if placed in a woman's uterus in the case of humans). Totipotent cells may give rise to an embryo, the extra embryonic membranes and all post-embryonic tissues and organs. The term "pluripotent" as used herein is intended to mean the ability of a cell to give rise to differentiated cells of all three embryonic germ layers. "Multipotent cells" refers to cells that can produce only cells of a closely related family of cells (e.g. hematopoietic stem cells differentiate into red blood cells, white blood cells, platelets, etc.). "Unipotent cells" refers to cells that have the capacity to develop/differentiate into only one type of tissue/cell type (e.g. skin cells).

The present invention allows the reprogramming of any cell to a different type of cell. Although the present application focuses primarily on the preparation of Stem-Like cells, especially, Neural Stem-Like Cells (NSLCs), the invention is not so restricted because many different types of cells can be generated according to the principles described herein. Similarly, while the Examples section describes embodiments where fibroblasts, keratinocytes, CD34$^+$ cells, adipose-derived stem cells (ADSCs), neural stem cells (including NSLCs), and cells within a Cell-Derived Matrix (CDM) are reprogrammed, the invention is not limited such cells. The invention may be employed for the reprogramming of virtually any cell of interest.

Accordingly, a general aspect of the invention relates to a method of transforming a cell of a first type to a cell of a second different type. As used herein, examples of cells of a first type include, but are not limited to germ cells, embryonic stem cells and derivations thereof, adult stem cells and derivations thereof, progenitor cells and derivations thereof, cells derived from mesoderm, endoderm or ectoderm, and a cell of mesoderm, endoderm or ectoderm lineage such as an adipose-derived stem cell (ADSC), mesenchymal stem cell, hematopoietic stem cell (CD34$^+$ cell), skin derived precursor cell, hair follicle cell, fibroblast, keratinocyte, epidermal cell, endothelial cell, epithelial cell, granulosa epithelial cell, melanocyte, adipocyte, chondrocyte, hepatocyte, lymphocyte (B and T lymphocyte), granulocyte, macrophage, monocyte, mononuclear cell, pancreatic islet cell, sertoli cell, neuron, glial cell, cardiac muscle cell, and other muscle cell.

As used herein, examples of cells of a second type include, but are not limited to germ cells, embryonic stem cells and derivations thereof, adult stem cells and derivations thereof, progenitor cells and derivations thereof, cells derived from mesoderm, endoderm or ectoderm, and a cell of mesoderm, endoderm or ectoderm lineage such as an adipose-derived stem cell, mesenchymal stem cell, hematopoietic stem cell, skin derived precursor cell, hair follicle cell, fibroblast, keratinocyte, epidermal cell, endothelial cell, epithelial cell, granulosa epithelial cell, melanocyte, adipocyte, chondrocyte, hepatocyte, lymphocyte (B and T lymphocyte), granulocyte, macrophage, monocyte, mononuclear cell, pancreatic islet cell, sertoli cell, neuron, glial cell, cardiac muscle cell, and other muscle cell. In addition, each of the above "-like" cell (a cell that has similar but not completely identical characteristics of the known natural type of the cell) is also included in the examples of cells of a second type.

According to one particular aspect, the method of transforming a cell of a first type into a cell of a second different type comprises the steps of:
i) providing a cell of a first type;
ii) transiently increasing in the cell of a first type intracellular levels of at least one reprogramming agent, whereby the transient increase induces direct or indirect endogenous expression of at least one gene regulator;
iii) placing the cell in conditions for supporting the transformation of the desired cell and maintaining intracellular levels of the at least one reprogramming agent for a sufficient period of time to allow stable expression of the at least one gene regulator in absence of the reprogramming agent; and
iv) maintaining the cell in culture conditions supporting the transformation of the desired cell for a sufficient period of time to allow a stable expression of a plurality of secondary genes whose expression is characteristic of phenotypical and functional properties of the desired cell. At the end of said period of time the cell of the first type has been transformed into the desired cell of a different type. Preferably, the cell of a different type obtained after the transformation is further characterized by a stable repression of a plurality of genes expressed in the first cell type.

According to one particular aspect, the method of transforming a cell of a first type into a cell of a second different type comprises the steps of:
i) providing a cell of a first type;
ii) transiently increasing in the cell of a first type intracellular levels of at least one reprogramming agent, whereby the transient increase induces direct or indirect endogenous expression of at least one gene regulator;
iii) placing the cell in conditions for supporting the transformation of the desired cell and maintaining intracellular levels of the at least one reprogramming agent for a sufficient period of time to allow stable expression of the at least one gene regulator in absence of the reprogramming agent; and
iv) maintaining the cell in culture conditions supporting the transformation of the desired cell for a sufficient period of time to allow a stable expression of a plurality of secondary genes whose expression is characteristic of phenotypical and functional properties of the desired cell. At least one of the stably expressed secondary genes is not characteristic of phenotypical and functional properties of an embryonic stem cell. At the end of said period of time the cell of the first type has been transformed into the desired cell of a different type. Preferably, the cell of a different type obtained after the transformation is further characterized by a stable repression of a plurality of genes expressed in the first cell type.

According to various embodiments, step iii) may be carried out consecutively to step ii), simultaneously with step ii), or before step ii).

According to a related aspect, the invention relates to a process wherein a cell of a first type is reprogrammed to a desired cell of a different type, the process comprising:
a transient increase of intracellular levels of at least one reprogramming agent, wherein the at least one reprogramming agent induces a direct or indirect endogenous expression of at least one gene regulator, wherein the endogenous expression of the at least one gene regulator is necessary for the existence of the desired cell of a different type;

a stable expression of said at least one gene regulator;
stable expression of a plurality of secondary genes, wherein the stable expression of the plurality of secondary genes is the result of the stable expression of the at least one gene regulator, and wherein: (i) stable expression of the plurality of secondary genes is characteristic of phenotypical and/or functional properties of the desired cell, (ii) stable expression of at least one of the secondary genes is not characteristic of phenotypical and functional properties of an embryonic stem cell, and wherein (i) and (H) are indicative of successful reprogramming of the cell of the first type to the desired cell of the different type.

As used herein, "transiently increasing" refers to an increase that is not necessarily permanent and therefore, which may decrease or disappear over time. For instance, when referring to transiently increasing intracellular levels of at least one reprogramming agent in a cell, it means that the increase in present for a sufficient period of time for causing particular cellular events to occur (e.g. Inducing stable endogenous expression of a gene regulator). Typically a transient increase is not permanent and is not associated for instance to genome integration of an expression vector.

As used herein the term "reprogramming agent" refers to a compound that is capable of inducing directly or indirectly the expression of morphological and/or functional characteristics of the desired cell of a different type. Preferred compounds include those capable of driving directly or indirectly transformation of the cell of the first type into the desired cell of a different type. In preferred embodiment, the reprogramming agent is selected for inducing a direct or Indirect endogenous expression of at least one gene regulator as defined herein. There are many compounds that may be helpful in reprogramming a cell according to the invention and these compounds can be used alone or in combinations. For example, the compound may be a molecule that induces epigenetic changes (chromatin remodeling, ex. histone acetylation and/or DNA demethylation) or a cytoskeleton disruptor that is helpful in reprogramming a cell according to the invention (or alternatively the culture conditions can include one or more compounds, materials, environmental (physical or chemical) effects or conditions that induce epigenetic changes and/or cytoskeleton disruptors that support the transformation to the desired cell). In various embodiments, the reprogramming agent is a polynucleotide or polypeptide selected according to TABLE A:

TABLE A

| | | Reprogramming agent | | |
|---|---|---|---|---|
| Examples of Desired Cell Type | Name | RefSeq/ GenBank ™ (NCBI) Accession No. and SEQ ID NO | UniProt ™/ Swiss-Prot Accession No. and SEQ ID NO | UniGene ™ Accession No. and SEQ ID NO |
| Pluripotent-like Cells Markers: OCT4 Nanog SSEA-4 TRA1-60 TRA1-81 AP | AGR2 | NM_006408.3 (SEQ ID NO: 1) | O95994 (SEQ ID NO: 2) | Hs.530009 (SEQ ID NO: 1) |
| | AGR3 | NM_176813.3 (SEQ ID NO: 3) | Q8TD06 (SEQ ID NO: 4) | Hs.100686 (SEQ ID NO: 3) |
| | BRIX1 | NM_018321.3 (SEQ ID NO: 5) | Q8TDN6 (SEQ ID NO: 6) | Hs.718510 (SEQ ID NO: 5) |
| | CRABP2 | NM_001878.2 (SEQ ID NO: 7) | P29373 (SEQ ID NO: 8) | Hs.405662 (SEQ ID NO: 9, 10) |
| | DNMT3B, isoform 1 | NM_006892.3 (SEQ ID NO: 11) | Q9UBC3 (SEQ ID NO: 12) | Hs.713611 (SEQ ID NO: 11) |
| | DNMT3B, isoform 2 | NM_175848.1 (SEQ ID NO: 13) | Q9UBC3 (SEQ ID NO: 14) | Hs.713611 (SEQ ID NO: 13) |
| | DNMT3B, isoform 3 | NM_175849.1 (SEQ ID NO: 15) | Q9UBC3 (SEQ ID NO: 16, 18, 19-22) | Hs.713611 (SEQ ID NO: 15) |
| | DNMT3B, isoform 6 | NM_175850.1 (SEQ ID NO: 17) | Q9UBC3 (SEQ ID NO: 16, 18, 19-22) | Hs.713611 (SEQ ID NO: 17) |
| | DPPA2 | NM_138815.3 (SEQ ID NO: 23) | Q7Z7J5 (SEQ ID NO: 24) | Hs.351113 (SEQ ID NO: 23) |
| | DPPA3 (STELLA) | NM_199286.2 (SEQ ID NO: 25) | Q6W0C5 (SEQ ID NO: 26) | Hs.131358 (SEQ ID NO: 25) |
| | DPPA4 | NM_018189.3 (SEQ ID NO: 27) | Q7L190 (SEQ ID NO: 28) | Hs.317659 (SEQ ID NO: 27) |
| | DPPA5 (ESG1) | NM_001025290.1 (SEQ ID NO: 29) | A6NC42 (SEQ ID NO: 30) | Hs.125331 (SEQ ID NO: 29) |
| | FOXD3 | NM_012183.2 (SEQ ID NO: 31) | Q9UJU5 (SEQ ID NO: 32) | Hs.546573 (SEQ ID NO: 31) |
| | FOXH1 | NM_003923.2 (SEQ ID NO: 33) | O75593 (SEQ ID NO: 34) | Hs.708365 (SEQ ID NO: 33) |
| | GABRB3, isoform 1 | NM_000814.5 (SEQ ID NO: 35) | P28472 (SEQ ID NO: 36) | Hs.302352 (SEQ ID NO: 35) |
| | GABRB3, isoform 2 | NM_021912.4 (SEQ ID NO: 37) | P28472 (SEQ ID NO: 38) | Hs.302352 (SEQ ID NO: 37) |
| | GABRB3, isoform 3 | NM_001191320.1 (SEQ ID NO: 39) | P28472 (SEQ ID NO: 40) | Hs.302352 (SEQ ID NO: 39) |
| | GABRB3, isoform 4 | NM_001191321.1 (SEQ ID NO: 41) | P28472 (SEQ ID NO: 42) | Hs.302352 (SEQ ID NO: 41) |
| | GBX2 | NM_001485.2 (SEQ ID NO: 43) | P52951 (SEQ ID NO: 44) | Hs.184945 (SEQ ID NO: 43) |
| | GDF3 | NM_020634.1 (SEQ ID NO: 45) | Q9NR23 (SEQ ID NO: 46) | Hs.86232 (SEQ ID NO: 45) |

TABLE A-continued

| | | Reprogramming agent | | |
|---|---|---|---|---|
| Examples of Desired Cell Type | Name | RefSeq/ GenBank ™ (NCBI) Accession No. and SEQ ID NO | UniProt ™/ Swiss-Prot Accession No. and SEQ ID NO | UniGene ™ Accession No. and SEQ ID NO |
| | GJA1 (CX43) | NM_000165.3 (SEQ ID NO: 47) | P17302 (SEQ ID NO: 48) | Hs.74471 (SEQ ID NO: 47) |
| | GRB7 | NM_005310.2 (SEQ ID NO: 49) | Q14451 (SEQ ID NO: 51-54) | Hs.86859 (SEQ ID NO: 55-58) |
| | | NM_001030002.1 (SEQ ID NO: 50) | Q14451 (SEQ ID NO: 51-54) | Hs.86859 (SEQ ID NO: 55-58) |
| | HESRG | NR_027122.1 (SEQ ID NO: 59) | Q1W209 (SEQ ID NO: 60) | Hs.720658 (SEQ ID NO: 59) |
| | IFITM1 | NM_003641.3 (SEQ ID NO: 61) | P13164 (SEQ ID NO: 62) | Hs.458414 (SEQ ID NO: 61) |
| | IFITM2 | NM_006435.2 (SEQ ID NO: 63) | Q01629 (SEQ ID NO: 64) | Hs.709321 (SEQ ID NO: 63) |
| | KLF2 | NM_016270.2 (SEQ ID NO: 65) | Q9Y5W3 (SEQ ID NO: 66) | Hs.726356 (SEQ ID NO: 65) |
| | KLF4 | NM_004235.4 (SEQ ID NO: 67) | O43474 (SEQ ID NO: 68-72) | Hs.376206 (SEQ ID NO: 67) |
| | LEFTY1 | NM_020997.2 (SEQ ID NO: 73) | O75610 (SEQ ID NO: 74) | Hs.656214 (SEQ ID NO: 75) |
| | LEFTY2 (EBAF), isoform 1 | NM_003240.3 (SEQ ID NO: 76) | O00292 (SEQ ID NO: 77) | Hs.520187 (SEQ ID NO: 76) |
| | LEFTY2 (EBAF), isoform 2 | NM_001172425.1 (SEQ ID NO: 78) | B4E332 (TrEMBL) (SEQ ID NO: 79) | Hs.520187 (SEQ ID NO: 78) |
| | LIN28A | NM_024674.4 (SEQ ID NO: 80) | Q9H9Z2 (SEQ ID NO: 81) | Hs.86154 (SEQ ID NO: 80) |
| | MYBL2 | NM_002466.2 (SEQ ID NO: 82) | P10244 (SEQ ID NO: 83) | Hs.179718 (SEQ ID NO: 82) |
| | NANOG | NM_024865.2 (SEQ ID NO: 84) | Q9H9S0 (SEQ ID NO: 85) | Hs.635882 (SEQ ID NO: 84) |
| | NODAL | NM_018055.4 (SEQ ID NO: 86) | Q96S42 (SEQ ID NO: 87) | Hs.370414 (SEQ ID NO: 86) |
| | NOG | NM_005450.4 (SEQ ID NO: 88) | Q13253 (SEQ ID NO: 89) | Hs.248201 (SEQ ID NO: 88) |
| | NR0B1 (DAX1) | NM_000475.4 (SEQ ID NO: 90) | P51843 (SEQ ID NO: 91, 92) | Hs.268490 (SEQ ID NO: 90) |
| | NR5A2, isoform 1 | NM_205860.1 (SEQ ID NO: 93) | O00482 (SEQ ID NO: 94) | Hs.33446 (SEQ ID NO: 95) |
| | NR5A2, isoform 2 | NM_003822.3 (SEQ ID NO: 96) | O00482 (SEQ ID NO: 97) | Hs.33446 (SEQ ID NO: 98) |
| | NR6A1, isoform 1 | NM_033334.2 (SEQ ID NO: 99) | Q15406 (SEQ ID NO: 100) | Hs.586460 (SEQ ID NO: 99) |
| | NR6A1, isoform 2 | NM_001489.3 (SEQ ID NO: 101) | Q15406 (SEQ ID NO: 102) | Hs.586460 (SEQ ID NO: 101) |
| | PHC1 | NM_004426.2 (SEQ ID NO: 103) | P78364 (SEQ ID NO: 104) | |
| | PITX2, isoform a | NM_153427.1 (SEQ ID NO: 105) | Q99697 (SEQ ID NO: 106) | Hs.643588 (SEQ ID NO: 107) |
| | PITX2, isoform b | NM_153426.1 (SEQ ID NO: 108) | Q99697 (SEQ ID NO: 109) | Hs.643588 (SEQ ID NO: 110) |
| | PITX2, isoform c | NM_000325.5 (SEQ ID NO: 111) | Q99697 (SEQ ID NO: 112) | Hs.643588 (SEQ ID NO: 111) |
| | PODXL, isoform 1 | NM_001018111.2 (SEQ ID NO: 113) | O00592 (SEQ ID NO: 114) | |
| | PODXL, isoform 2 | NM_005397.3 (SEQ ID NO: 115) | O00592 (SEQ ID NO: 116) | |
| | POU5F1 (OCT4), isoform 1* | NM_002701.4 (SEQ ID NO: 117) | Q01860 (SEQ ID NO: 118) | Hs.249184 (SEQ ID NO: 117) |
| | POU5F1 (OCT4), isoform 2 | NM_203289.4 (SEQ ID NO: 119) NM_001173531.1 (SEQ ID NO: 120) | N/A (SEQ ID NO: 121) | Hs.249184 (SEQ ID NO: 119, 120) |
| | PTEN | NM_000314.4 (SEQ ID NO: 122) | P60484 (SEQ ID NO: 123) | Hs.500466 (SEQ ID NO: 122) |
| | REST | NM_005612.4 (SEQ ID NO: 124) | Q13127 (SEQ ID NO: 126-129) | Hs.307836 (SEQ ID NO: 124, 125) |
| | | NM_001193508.1 (SEQ ID NO: 125) | Q13127 (SEQ ID NO: 126-129) | Hs.307836 (SEQ ID NO: 124, 125) |

TABLE A-continued

Reprogramming agent

| Examples of Desired Cell Type | Name | RefSeq/ GenBank™ (NCBI) Accession No. and SEQ ID NO | UniProt™/ Swiss-Prot Accession No. and SEQ ID NO | UniGene™ Accession No. and SEQ ID NO |
|---|---|---|---|---|
| | REX1 | NM_020695.3 (SEQ ID NO: 130) | Q8N1G1 (SEQ ID NO: 131) | Hs.192477 (SEQ ID NO: 130) |
| | SALL4 | NM_020436.3 (SEQ ID NO: 132) | Q9UJQ4 (SEQ ID NO: 133) | Hs.517113 (SEQ ID NO: 132) |
| | SEMA3A | NM_006080.2 (SEQ ID NO: 134) | Q14563 (SEQ ID NO: 135) | Hs.252451 (SEQ ID NO: 134) |
| | SFRP2 | NM_003013.2 (SEQ ID NO: 136) | Q96HF1 (SEQ ID NO: 137) | Hs.481022 (SEQ ID NO: 136) |
| | SOX2 | NM_003106.2 (SEQ ID NO: 138) | P48431 (SEQ ID NO: 139) | Hs.518438 (SEQ ID NO: 140) |
| | TDGF1, isoform 1 | NM_003212.3 (SEQ ID NO: 141) | P13385 (SEQ ID NO: 142) | Hs.385870 (SEQ ID NO: 141) |
| | TDGF1, isoform 2 | NM_001174136.1 (SEQ ID NO: 143) | P13385 (SEQ ID NO: 142) | Hs.385870 (SEQ ID NO: 141) |
| | TERT, isoform 1 | NM_198253.2 (SEQ ID NO: 144) | O14746 (SEQ ID NO: 145) | Hs.492203 (SEQ ID NO: 144) |
| | TERT, isoform 2 | NM_001193376.1 (SEQ ID NO: 146) | O14746 (SEQ ID NO: 147) | Hs.492203 (SEQ ID NO: 146) |
| | TPT1 | NM_003295.2 (SEQ ID NO: 148) | P13693 (SEQ ID NO: 149) | Hs.374596 (SEQ ID NO: 148) |
| | UTF1 | NM_003577.2 (SEQ ID NO: 150) | Q5T230 (SEQ ID NO: 151) | Hs.458406 (SEQ ID NO: 150) |
| | ZFP42 (REX1) | NM_174900.3 (SEQ ID NO: 152) | Q96MM3 (SEQ ID NO: 153) | Hs.335787 (SEQ ID NO: 152) |
| Ectoderm-like Cells Markers: FoxJ3 Otx2 E-cadherin Nestin Sox2 Sox1 ZIC1 | ASCL1 (MASH1) | NM_004316.3 (SEQ ID NO: 154) | P50553 (SEQ ID NO: 155) | Hs.703025 (SEQ ID NO: 154) |
| | CDX1 | NM_001804.2 (SEQ ID NO: 156) | P47902 (SEQ ID NO: 157, 158) | Hs.1545 (SEQ ID NO: 156) |
| | DLX3 | NM_005220.2 (SEQ ID NO: 159) | O60479 (SEQ ID NO: 160) | Hs.134194 (SEQ ID NO: 159) |
| | Nestin | NM_006617 (SEQ ID NO: 332) | P48681 (SEQ ID NO: 333) | Hs.527971 (SEQ ID NO: 332) |
| | DLX5 | NM_005221.5 (SEQ ID NO: 161) | P56178 (SEQ ID NO: 162, 163) | Hs.99348 (SEQ ID NO: 161) |
| | FOXD3 | NM_012183.2 (SEQ ID NO: 31) | Q9UJU5 (SEQ ID NO: 32) | Hs.546573 (SEQ ID NO: 31) |
| | MSI1 | NM_002442.2 (SEQ ID NO: 164) | O43347 (SEQ ID NO: 165) | Hs.158311 (SEQ ID NO: 166) |
| | NANOG | NM_024865.2 (SEQ ID NO: 84) | Q9H9S0 (SEQ ID NO: 85) | Hs.635882 (SEQ ID NO: 84) |
| | POU5F1 (OCT4), isoform 1* | NM_002701.4 (SEQ ID NO: 117) | Q01860 (SEQ ID NO: 118) | Hs.249184 (SEQ ID NO: 117) |
| | POU5F1 (OCT4), isoform 2 | NM_203289.4 (SEQ ID NO: 119) NM_001173531.1 (SEQ ID NO: 120) | N/A (SEQ ID NO: 121) | Hs.249184 (SEQ ID NO: 119, 120) |
| | SOX1 | NM_005986.2 (SEQ ID NO: 167) | O00570 (SEQ ID NO: 168) | Hs.202526 (SEQ ID NO: 167) |
| | SOX2 | NM_003106.2 (SEQ ID NO: 138) | P48431 (SEQ ID NO: 139) | Hs.518438 (SEQ ID NO: 140) |
| | SP8, isoform 1 | NM_182700.4 (SEQ ID NO: 169) | Q8IXZ3 (SEQ ID NO: 170) | Hs.195922 (SEQ ID NO: 169) |
| | SP8, isoform 2 | NM_198956.2 (SEQ ID NO: 171) | N/A (SEQ ID NO: 172-174) | Hs.195922 (SEQ ID NO: 171) |
| | ZIC1 | NM_003412.3 (SEQ ID NO: 175) | Q15915 (SEQ ID NO: 176) | Hs.647962 (SEQ ID NO: 175) |
| Mesendoderm-like Cells Markers: FoxA2 GATA4 Mixl1 Eomesodermin Brachyury | EOMES | NM_005442.2 (SEQ ID NO: 177) | O95936 (SEQ ID NO: 178-181) | Hs.591663 (SEQ ID NO: 177) |
| | FOXA2, isoform 1* | NM_021784.4 (SEQ ID NO: 182) | Q9Y261 (SEQ ID NO: 183) | Hs.155651 (SEQ ID NO: 182) |
| | FOXA2, isoform 2 | NM_153675.2 (SEQ ID NO: 184) | Q9Y261 (SEQ ID NO: 185) | Hs.155651 (SEQ ID NO: 184) |
| | FOXD3 | NM_012183.2 (SEQ ID NO: 31) | Q9UJU5 (SEQ ID NO: 32) | Hs.546573 (SEQ ID NO: 31) |
| | GATA4 | NM_002052.3 (SEQ ID NO: 186) | P43694 (SEQ ID NO: 187) | Hs.243987 (SEQ ID NO: 186) |
| | GATA6 | NM_005257.3 (SEQ ID NO: 188) | Q92908 (SEQ ID NO: 189, 190) | Hs.514746 (SEQ ID NO: 191) |

TABLE A-continued

| | | Reprogramming agent | | |
|---|---|---|---|---|
| Examples of Desired Cell Type | Name | RefSeq/ GenBank ™ (NCBI) Accession No. and SEQ ID NO | UniProt ™/ Swiss-Prot Accession No. and SEQ ID NO | UniGene ™ Accession No. and SEQ ID NO |
| | MIXL1 | NM_031944.1 (SEQ ID NO: 192) | Q9H2W2 (SEQ ID NO: 193) | Hs.282079 (SEQ ID NO: 192) |
| | POU5F1 (OCT4), isoform 1* | NM_002701.4 (SEQ ID NO: 117) | Q01860 (SEQ ID NO: 117) | Hs.249184 (SEQ ID NO: 118) |
| | POU5F1 (OCT4), isoform 2 | NM_203289.4 (SEQ ID NO: 119) NM_001173531.1 (SEQ ID NO: 120) | N/A (SEQ ID NO: 121) | Hs.249184 (SEQ ID NO: 119, 120) |
| | SOX17 | NM_022454.3 (SEQ ID NO: 194) | Q9H6I2 (SEQ ID NO: 195) | Hs.98367 (SEQ ID NO: 194) |
| | T (Brachyury) | NM_003181.2 (SEQ ID NO: 196) | O15178 (SEQ ID NO: 197) | Hs.389457 (SEQ ID NO: 198, 199) |
| Neural Stem-like Cells Markers: Sox2 Nestin GFAP Msi1 CD133 Doublecortin | ASCL1 (Mash1) | NM_004316.3 (SEQ ID NO: 334) | P50553 (SEQ ID NO: 335) | Hs.703025 (SEQ ID NO: 334) |
| | BMI-1 | NM_005180.08 (SEQ ID NO: 336) | P35226 (SEQ ID NO: 337) | Hs.731287 (SEQ ID NO: 336) |
| | CALB1 | NM_004929.2 (SEQ ID NO: 200) | P05937 (SEQ ID NO: 201) | Hs.65425 (SEQ ID NO: 200) |
| | DLL1 | NM_005618.3 (SEQ ID NO: 202) | O00548 (SEQ ID NO: 203, 204) | Hs.379912 (SEQ ID NO: 202) |
| | DLX1, isoform 1 | NM_178120.4 (SEQ ID NO: 205) | P56177 (SEQ ID NO: 206) | Hs.407015 (SEQ ID NO: 205) |
| | DLX1, isoform 2 | NM_001038493.1 (SEQ ID NO: 207) | P56177 (SEQ ID NO: 208) | Hs.407015 (SEQ ID NO: 207) |
| | DLX2 | NM_004405.3 (SEQ ID NO: 209) | Q07687 (SEQ ID NO: 210, 211) | Hs.419 (SEQ ID NO: 209) |
| | FOXD3 | NM_012183.2 (SEQ ID NO: 31) | Q9UJU5 (SEQ ID NO: 32) | Hs.546573 (SEQ ID NO: 31) |
| | GJD2 (CX36) | NM_020660.1 (SEQ ID NO: 212) | Q9UKL4 (SEQ ID NO: 213) | Hs.283816 (SEQ ID NO: 214) |
| | HES1 | NM_005524.3 (SEQ ID NO: 215) | Q14469 (SEQ ID NO: 216) | Hs.250666 (SEQ ID NO: 217) |
| | HES3 | NM_001024598.3 (SEQ ID NO: 218) | Q5TGS1 (SEQ ID NO: 219) | Hs.532677 (SEQ ID NO: 218) |
| | HES5 | NM_001010926.3 (SEQ ID NO: 220) | Q5TA89 (SEQ ID NO: 221) | Hs.57971 (SEQ ID NO: 220) |
| | HOXB1 | NM_002144.3 (SEQ ID NO: 222) | P14653 (SEQ ID NO: 223, 224) | Hs.99992 (SEQ ID NO: 222) |
| | KLF4 | NM_004235.4 (SEQ ID NO: 67) | O43474 (SEQ ID NO: 68-72) | Hs.376206 (SEQ ID NO: 67) |
| | MBD2 | NM_015832.4 (SEQ ID NO: 338) | Q9UBB5 (SEQ ID NO: 339) | Hs.25674 (SEQ ID NO: 338) |
| | MNX1 (HB9), isoform 1 | NM_005515.3 (SEQ ID NO: 225) | P50219 (SEQ ID NO: 226) | Hs.37035 (SEQ ID NO: 225) |
| | MNX1 (HB9), isoform 2 | NM_001165255.1 (SEQ ID NO: 227) | N/A (SEQ ID NO: 228) | Hs.37035 (SEQ ID NO: 227) |
| | MSI1 | NM_002442.2 (SEQ ID NO: 164) | O43347 (SEQ ID NO: 165) | Hs.158311 (SEQ ID NO: 166) |
| | MSI2 | NM_170721.1 (SEQ ID NO: 340) | Q96DH6 (SEQ ID NO: 341) | Hs658922 (SEQ ID NO: 340) |
| | NANOG | NM_024865.2 (SEQ ID NO: 84) | Q9H9S0 (SEQ ID NO: 85) | Hs.635882 (SEQ ID NO: 84) |
| | NESTIN | NM_006617 (SEQ ID NO: 332) | P48681 (SEQ ID NO: 333) | Hs.527971 (SEQ ID NO: 332) |
| | NEUROD1 | NM_002500.2 (SEQ ID NO: 229) | Q13562 (SEQ ID NO: 230) | Hs.709709 (SEQ ID NO: 231) |
| | NEUROD2 | NM_006160.3 (SEQ ID NO: 342) | Q15784 (SEQ ID NO: 343) | Hs.322431 (SEQ ID NO: 342) |
| | NEUROG1 | NM_006161.2 (SEQ ID NO: 232) | Q92886 (SEQ ID NO: 233) | Hs.248149 (SEQ ID NO: 232) |
| | NEUROG2 | NM_024019.2 (SEQ ID NO: 234) | Q9H2A3 (SEQ ID NO: 235) | |
| | NEUROG3 | NM_020999.3 (SEQ ID NO: 287) | Q9Y4Z2 (SEQ ID NO: 286) | Hs.532682 (SEQ ID NO: 287) |
| | NKX6.1 | NM_006168.2 (SEQ ID NO: 236) | P78426 (SEQ ID NO: 237) | Hs.546270 (SEQ ID NO: 236) |
| | Nucleostemin | NM_206826.1 (SEQ ID NO: 344) | Q9BVP2 (SEQ ID NO: 345) | Hs.313544 (SEQ ID NO: 344) |

TABLE A-continued

Reprogramming agent

| Examples of Desired Cell Type | Name | RefSeq/ GenBank™ (NCBI) Accession No. and SEQ ID NO | UniProt™/ Swiss-Prot Accession No. and SEQ ID NO | UniGene™ Accession No. and SEQ ID NO |
|---|---|---|---|---|
| | Olig2 | NM_005806.3 (SEQ ID NO: 346) | Q13516 (SEQ ID NO: 347) | Hs.732068 (SEQ ID NO: 346) |
| | Olig3 | NM_175747.2 (SEQ ID NO: 348) | Q7RTU3 (SEQ ID NO: 349) | Hs.195398 (SEQ ID NO: 348) |
| | PAX3 | NM_181461.3 (SEQ ID NO: 319) | P23760 (SEQ ID NO: 311, 313, 315) | Hs.42146 (SEQ ID NO: 319) |
| | PAX6, isoform a* | NM_000280.3 (SEQ ID NO: 238) | P26367 (SEQ ID NO: 241, 242) | Hs.270303 (SEQ ID NO: 243-248) |
| | PAX6, isoform a | NM_001127612.1 (SEQ ID NO: 239) | P26367 (SEQ ID NO: 241, 242) | Hs.270303 (SEQ ID NO: 243-248) |
| | PAX6, isoform b | NM_001604.4 (SEQ ID NO: 240) | P26367 (SEQ ID NO: 241, 242) | Hs.270303 (SEQ ID NO: 243-248) |
| | SFRP2 | NM_003013.2 (SEQ ID NO: 136) | Q96HF1 (SEQ ID NO: 137) | Hs.481022 (SEQ ID NO: 136) |
| | SIX3 | NM_005413.3 (SEQ ID NO: 249) | O95343 (SEQ ID NO: 250) | Hs.567336 (SEQ ID NO: 249) |
| | SOX1 | NM_005986.2 (SEQ ID NO: 167) | O00570 (SEQ ID NO: 168) | Hs.202526 (SEQ ID NO: 167) |
| | SOX2 | NM_003106.2 (SEQ ID NO: 138) | P48431 (SEQ ID NO: 139) | Hs.518438 (SEQ ID NO: 140) |
| | SOX3 | NM_005634.2 (SEQ ID NO: 350) | P41225 (SEQ ID NO: 351) | Hs.157429 (SEQ ID NO: 350) |
| | SOX9 | NM_000346.3 (SEQ ID NO: 352) | P48436 (SEQ ID NO: 353) | Hs.647409 (SEQ ID NO: 352) |
| | SOX10 | NM_006941.3 (SEQ ID NO: 354) | P56693 (SEQ ID NO: 355) | Hs.376984 (SEQ ID NO: 354) |
| | SOX11 | NM_003108.3 (SEQ ID NO: 356) | P35716 (SEQ ID NO: 357) | Hs.432638 (SEQ ID NO: 356) |
| | SOX21 | NM_007084.2 (SEQ ID NO: 358) | Q9Y651 (SEQ ID NO: 359) | Hs.187577 (SEQ ID NO: 358) |
| | ZIC1 | NM_003412.3 (SEQ ID NO: 175) | Q15915 (SEQ ID NO: 176) | Hs.647962 (SEQ ID NO: 175) |
| | ZIC3 | NM_003413.3 (SEQ ID NO: 360) | Q60481 (SEQ ID NO: 361) | Hs.111227 (SEQ ID NO: 360) |
| Cardiac Stem-like Cells Markers: CD133 MLc2α Nkx2.5 Isl1 Brachyury GATA4 | BAF60C (SMARCD3), isoform 1 | NM_001003802.1 (SEQ ID NO: 251) | Q6STE5 (SEQ ID NO: 253, 256) | Hs.647067 (SEQ ID NO: 251, 252, 255) |
| | BAF60C (SMARCD3), isoform 1 | NM_003078.3 (SEQ ID NO: 252) | Q6STE5 (SEQ ID NO: 253, 256) | Hs.647067 (SEQ ID NO: 251, 252, 255) |
| | BAF60C (SMARCD3), isoform 2* | NM_001003801.1 (SEQ ID NO: 255) | Q6STE5 (SEQ ID NO: 253, 256) | Hs.647067 (SEQ ID NO: 251, 252, 255) |
| | FOXD3 | NM_012183.2 (SEQ ID NO: 31) | Q9UJU5 (SEQ ID NO: 32) | Hs.546573 (SEQ ID NO: 31) |
| | GATA4 | NM_002052.3 (SEQ ID NO: 186) | P43694 (SEQ ID NO: 187) | Hs.243987 (SEQ ID NO: 186) |
| | GATA6 | NM_005257.3 (SEQ ID NO: 188) | Q92908 (SEQ ID NO: 189, 190) | Hs.514746 (SEQ ID NO: 191) |
| | HAND1 | NM_004821.2 (SEQ ID NO: 257) | O96004 (SEQ ID NO: 258) | Hs.152531 (SEQ ID NO: 257) |
| | HAND2 | NM_021973.2 (SEQ ID NO: 259) | P61296 (SEQ ID NO: 260) | Hs.388245 (SEQ ID NO: 259) |
| | ISL1 | NM_002202.2 (SEQ ID NO: 261) | P61371 (SEQ ID NO: 262) | Hs.505 (SEQ ID NO: 261) |
| | KDR | NM_002253.2 (SEQ ID NO: 263) | P35968 (SEQ ID NO: 264-266) | Hs.479756 (SEQ ID NO: 263) |
| | MEF2C, isoform 1 | NM_002397.4 (SEQ ID NO: 298) NM_001193350.1 (SEQ ID NO: 299) | Q06413 (SEQ ID NO: 300) Q06413 (SEQ ID NO: 300) | Hs.649965 (SEQ ID NO: 298, 299) |
| | MEF2C, isoform 2 | NM_001131005.2 (SEQ ID NO: 301) | Q06413 (SEQ ID NO: 302) | Hs.649965 (SEQ ID NO: 301) |
| | MEF2C, isoform 3 | NM_001193347.1 (SEQ ID NO: 303) | Q06413 (SEQ ID NO: 304) | Hs.649965 (SEQ ID NO: 303) |
| | MEF2C, isoform 4 | NM_001193348.1 (SEQ ID NO: 305) | Q06413 (SEQ ID NO: 306) | Hs.649965 (SEQ ID NO: 305) |
| | MEF2C, | NM_001193349.1 | Q06413 | Hs.649965 |

TABLE A-continued

| | | Reprogramming agent | | |
|---|---|---|---|---|
| Examples of Desired Cell Type | Name | RefSeq/ GenBank ™ (NCBI) Accession No. and SEQ ID NO | UniProt ™/ Swiss-Prot Accession No. and SEQ ID NO | UniGene ™ Accession No. and SEQ ID NO |
| | isoform 5 | (SEQ ID NO: 307) | (SEQ ID NOs: 308 and 309) | (SEQ ID NO: 305) |
| | MESP1 | NM_018670.3 (SEQ ID NO: 267) | Q9BRJ9 (SEQ ID NO: 268) | Hs.447531 (SEQ ID NO: 267) |
| | MIXL1 | NM_031944.1 (SEQ ID NO: 192) | Q9H2W2 (SEQ ID NO: 193) | Hs.282079 (SEQ ID NO: 192) |
| | MYOCD, isoform 1 | NM_001146312.1 (SEQ ID NO: 269) | Q6N065 (TrEMBL) (SEQ ID NO: 270) | Hs.567641 (SEQ ID NO: 269) |
| | MYOCD, isoform 2 | NM_153604.2 (SEQ ID NO: 271) | Q8IZQ8 (SEQ ID NO: 272) | Hs.567641 (SEQ ID NO: 271) |
| | NKX2.5, isoform 1* | NM_004387.3 (SEQ ID NO: 254) | P52952 (SEQ ID NO: 273) | Hs.54473 (SEQ ID NO: 254, 274, 276) |
| | NKX2.5, isoform 2* | NM_001166175.1 (SEQ ID NO: 274) | P52952 (SEQ ID NO: 275) | Hs.54473 (SEQ ID NO: 254, 274, 276) |
| | NKX2.5, isoform 3* | NM_001166176.1 (SEQ ID NO: 276) | P52952 (SEQ ID NO: 277) | Hs.54473 (SEQ ID NO: 254, 274, 276) |
| | Snail-1 | NM_005985.3 (SEQ ID NO: 362) | O95863 (SEQ ID NO: 363) | Hs.48029 (SEQ ID NO: 362) |
| | T (Brachyury) | NM_003181.2 (SEQ ID NO: 196) | O15178 (SEQ ID NO: 197) | Hs.389457 (SEQ ID NO: 198, 199) |
| | TBX5, isoform 1* | NM_000192.3 (SEQ ID NO: 278) | Q99593 (SEQ ID NO: 279) | Hs.381715 (SEQ ID NO: 278, 280, 281) |
| | TBX5, isoform 1 | NM_181486.1 (SEQ ID NO: 280, 281) | Q99593 (SEQ ID NO: 279) | Hs.381715 (SEQ ID NO: 278, 280, 281) |
| | TBX5, isoform 3 | NM_080717.2 (SEQ ID NO: 282) | Q99593 (SEQ ID NO: 283) | Hs.381715 (SEQ ID NO: 282) |
| | TBX18 | NM_181486.2 (SEQ ID NO: 364) | Q99593 (SEQ ID NO: 365) | Hs.381715 (SEQ ID NO: 364) |
| | SOX17 | NM_022454.3 (SEQ ID NO: 194) | O9H6I2 (SEQ ID NO: 195) | Hs.98367 (SEQ ID NO: 194) |
| Pancreatic Progenitor-like Cells Markers: PDX1 Sox17 FoxA2 Ngn3 Isl1 | FOXA2, isoform 1* | NM_021784.4 (SEQ ID NO: 182) | Q9Y261 (SEQ ID NO: 183) | Hs.155651 (SEQ ID NO: 182) |
| | FOXA2, isoform 2 | NM_153675.2 (SEQ ID NO: 184) | Q9Y261 (SEQ ID NO: 185) | Hs.155651 (SEQ ID NO: 184) |
| | FOXD3 | NM_012183.2 (SEQ ID NO: 31) | Q9UJU5 (SEQ ID NO: 32) | Hs.546573 (SEQ ID NO: 31) |
| | MAFA | NM_201589.2 (SEQ ID NO: 284) | Q8NHW3 (SEQ ID NO: 285) | Hs.670866 (SEQ ID NO: 284) |
| | MIXL1 | NM_031944.1 (SEQ ID NO: 192) | Q9H2W2 (SEQ ID NO: 193) | Hs.282079 (SEQ ID NO: 192) |
| | NEUROG3 | NM_020999.3 (SEQ ID NO: 287) | Q9Y4Z2 (SEQ ID NO: 286) | Hs.532682 (SEQ ID NO: 287) |
| | NKX6.1 | NM_006168.2 (SEQ ID NO: 236) | P78426 (SEQ ID NO: 237) | Hs.546270 (SEQ ID NO: 236) |
| | PAX4 | NM_006193.2 (SEQ ID NO: 289) | O43316 (SEQ ID NO: 290-292) | Hs.129706 (SEQ ID NO: 289) |
| | PDX1 | NM_000209.3 (SEQ ID NO: 293) | P52945 (SEQ ID NO: 294) | Hs.32938 (SEQ ID NO: 293) |
| | SOX17 | NM_022454.3 (SEQ ID NO: 194) | Q9H6I2 (SEQ ID NO: 195) | Hs.98367 (SEQ ID NO: 194) |
| Hematopoietic Stem-like Cells Markers: CD34 CXCR4 Flt3 Sca-1 HoxB4 | BMI1 | NM_005180.8. (SEQ ID NO: 336) | P35226. (SEQ ID NO: 337) | Hs.731287 (SEQ ID NO: 336) |
| | CDX4 | NM_005193.1 (SEQ ID NO: 366) | O14627 (SEQ ID NO: 367) | Hs.553488 (SEQ ID NO: 366) |
| | FLI1 | NM_001167681.2. (SEQ ID NO: 368) | Q01543 (SEQ ID NO: 369) | Hs.504281 (SEQ ID NO: 368) |
| | GATA1 | NM_002049 (SEQ ID NO: 370) | P15976 (SEQ ID NO: 371) | Hs.765 (SEQ ID NO: 370) |
| | GATA2 | NM_001145661 (SEQ ID NO: 372) | P23769 (SEQ ID NO: 373) | Hs.367725 (SEQ ID NO: 372) |
| | HoxB4 | NM_024015 (SEQ ID NO: 374) | P17483 (SEQ ID NO: 375) | Hs.664706 (SEQ ID NO: 374) |
| | ISL1 | NM_002202.2 (SEQ ID NO: 261) | P61371 (SEQ ID NO: 262) | Hs.505 (SEQ ID NO: 261) |
| | KLF1 | NM_006563 (SEQ ID NO: 376) | Q13351. (SEQ ID NO: 377) | Hs.37860 (SEQ ID NO: 376) |

TABLE A-continued

| Examples of Desired Cell Type | Name | RefSeq/ GenBank ™ (NCBI) Accession No. and SEQ ID NO | UniProt ™/ Swiss-Prot Accession No. and SEQ ID NO | UniGene ™ Accession No. and SEQ ID NO |
|---|---|---|---|---|
| | LMO2 | NM_001142315.1. (SEQ ID NO: 378) | P25791 (SEQ ID NO: 379) | Hs.34560 (SEQ ID NO: 378) |
| | LMO4 | NM_006769.3 (SEQ ID NO: 380) | P61968 (SEQ ID NO: 381) | Hs.436792 (SEQ ID NO: 380) |
| | Runx1 | NM_001001890.2. (SEQ ID NO: 382) | Q01196 (SEQ ID NO: 383) | Hs.149261 (SEQ ID NO: 382) |
| | T (Brachyury) | NM_003181.2 (SEQ ID NO: 196) | O15178 (SEQ ID NO: 197) | Hs.389457 (SEQ ID NO: 198, 199) |
| | TAL1 | NM_003189.2. (SEQ ID NO: 384) | P17542 (SEQ ID NO: 385) | Hs.705618 (SEQ ID NO: 384) |
| Myogenic (Muscle) Stem-like Cells Markers: αSM actinin Calponin MyoD MEF2C Pax3 Pax7 | FOXC1 | NM_001453.2 (SEQ ID NO: 295) | Q12948 (SEQ ID NO: 296) | Hs.348883 (SEQ ID NO: 295) |
| | FOXC2 | NM_005251.2 (SEQ ID NO: 286) | Q99958 (SEQ ID NO: 297) | Hs.436448 (SEQ ID NO: 286) |
| | FOXK1 | NM_001037165.1 (SEQ ID NO: 386) | P58037 (SEQ ID NO: 387) | Hs.487393 (SEQ ID NO: 386) |
| | MEF2C, isoform 1 | NM_002397.4 (SEQ ID NO: 298) NM_001193350.1 (SEQ ID NO: 299) | Q06413 (SEQ ID NO: 300) Q06413 (SEQ ID NO: 300) | Hs.649965 (SEQ ID NO: 298, 299) |
| | MEF2C, isoform 2 | NM_001131005.2 (SEQ ID NO: 301) | Q06413 (SEQ ID NO: 302) | Hs.649965 (SEQ ID NO: 301) |
| | MEF2C, isoform 3 | NM_001193347.1 (SEQ ID NO: 303) | Q06413 (SEQ ID NO: 304) | Hs.649965 (SEQ ID NO: 303) |
| | MEF2C, isoform 4 | NM_001193348.1 (SEQ ID NO: 305) | Q06413 (SEQ ID NO: 306) | Hs.649965 (SEQ ID NO: 305) |
| | MEF2C, isoform 5 | NM_001193349.1 (SEQ ID NO: 307) | Q06413 (SEQ ID NO: 308, 309) | Hs.649965 (SEQ ID NO: 307) |
| | MYF3 (MyoD) | NM_002478.4 (SEQ ID NO: 388) | P15172 (SEQ ID NO: 389) | Hs.81768 (SEQ ID NO: 388) |
| | MYF4 (Myogenin) | NM_002479.5 (SEQ ID NO: 390) | P15173 (SEQ ID NO: 391) | Hs.2830 (SEQ ID NO: 390) |
| | MYF5 | NM_005593.2 (SEQ ID NO: 392) | P13349 (SEQ ID NO: 393) | Hs178023 (SEQ ID NO: 392) |
| | Pax3, isoform Pax3 | NM_181457.3 (SEQ ID NO: 310) | P23760 (SEQ ID NO: 311) | Hs.42146 (SEQ ID NO: 310) |
| | Pax3, isoform Pax3a | NM_000438.5 (SEQ ID NO: 312) | P23760 (SEQ ID NO: 313) | Hs.42146 (SEQ ID NO: 312) |
| | Pax3, isoform Pax3b | NM_013942.4 (SEQ ID NO: 314) | P23760 (SEQ ID NO: 315) | Hs.42146 (SEQ ID NO: 314) |
| | Pax3, isoform Pax3d | NM_181458.3 (SEQ ID NO: 316) | Q494Z3, Q494Z4 (TrEMBL) (SEQ ID NO: 318) | Hs.42146 (SEQ ID NO: 316) |
| | Pax3, isoform Pax3e | NM_181459.3 (SEQ ID NO: 317) | Q494Z3, Q494Z4 (TrEMBL) (SEQ ID NO: 318) | Hs.42146 (SEQ ID NO: 317) |
| | Pax3, isoform Pax3g | NM_181461.3 (SEQ ID NO: 319) | Q494Z3, Q494Z4 (TrEMBL) (SEQ ID NO: 320) | Hs.42146 (SEQ ID NO: 319) |
| | Pax3, isoform Pax3h | NM_181460.3 (SEQ ID NO: 321) | Q494Z3, Q494Z4 (TrEMBL) (SEQ ID NO: 22) | Hs.42146 (SEQ ID NO: 321) |
| | Pax3, isoform Pax3i | NM_001127366.2 (SEQ ID NO: 323) | Q494Z4 (TrEMBL) (SEQ ID NO: 324, 325) | Hs.42146 (SEQ ID NO: 323) |
| | PAX7, isoform 1 | NM_002584.2 (SEQ ID NO: 326) | P23759 (SEQ ID NO: 327) | Hs.113253 (SEQ ID NO: 326) |
| | PAX7, isoform 2 | NM_013945.2 (SEQ ID NO: 328) | P23759 (SEQ ID NO: 329) | Hs.113253 (SEQ ID NO: 328) |
| | PAX7, isoform 3 | NM_001135254.1 (SEQ ID NO: 330) | P23759 (SEQ ID NO: 331) | Hs.113253 (SEQ ID NO: 330) |

In some embodiments, the reprogramming agent is a polypeptide which shares at least 75%, 80%, 85%, 90%, 95%, 97%, 99% or more of the functionality or sequence identity of any one of the reprogramming agents in the table hereinbefore.

Identifying the "sufficient period of time" to allow stable expression of the at least one gene regulator in absence of the reprogramming agent and the "sufficient period of time" in which the cell is to be maintained in culture conditions supporting the transformation of the desired cell is within the skill of those in the art. The sufficient or proper time period will vary according to various factors, including but not limited to, the particular type and epigenetic status of cells (e.g. the cell of the first type and the desired cell), the amount of starting material (e.g. the number of cells to be transformed), the amount and type of reprogramming agent(s), the gene regulator(s), the culture conditions, presence of compounds that speed up reprogramming (ex, compounds that increase cell cycle turnover, modify the epigenetic status, and/or enhance cell viability), etc. In various embodiments the sufficient period of time to allow a stable expression of the at least one gene regulator in absence of the reprogramming agent is about 1 day, about 2-4 days, about 4-7 days, about 1-2 weeks, about 2-3 weeks or about 3-4 weeks. In various embodiments the sufficient period of time in which the cells are to be maintained in culture conditions supporting the transformation of the desired cell and allow a stable expression of a plurality of secondary genes is about 1 day, about 2-4 days, about 4-7 days, or about 1-2 weeks, about 2-3 weeks, about 3-4 weeks, about 4-6 weeks or about 6-8 weeks. In preferred embodiments, at the end of the transformation period, the number of transformed desired cells is substantially equivalent or even higher than an amount of cells a first type provided at the beginning.

The present invention encompasses various types of compounds that are suitable for increasing in a cell of a first type the intracellular levels of at least one reprogramming agent. Preferably, the compound should also be able to directly or indirectly remodel the chromatin and/or DNA of the cell, thus resulting directly or indirectly in the expression of morphological and functional characteristics of the desired cell of a different type. Preferred compounds are reprogramming agents as defined herein or any other compound having a similar activity and having the ability to activate or enhance the expression of the endogenous version of genes listed in the table of reprogramming agents hereinbefore and which are capable of driving directly or indirectly transformation of the cell of the first type into the desired cell of a different type.

As will be explained hereinafter, the increase in intracellular levels of the at least one reprogramming agent can be achieved by different means. In preferred embodiments the reprogramming agent is a polypeptide and increasing intracellular levels of such polypeptide include transfection (or co-transfection) of an expression vector having a polynucleotide (ex. DNA or RNA) encoding the polypeptide(s), or by an intracellular delivery of polypeptide(s). According to the invention, transient expression is generally preferable. Additional suitable compounds may include compounds capable of increasing the expression of the endogenous version of genes listed in the table of reprogramming agents and gene regulators including, but not limited to, reprogramming factors listed in Table B.

TABLE B

| Desired cell type | Reprogramming Factor |
| --- | --- |
| Pluripotent-like Cells | Y27632, Butyric acid, Hydrocortisone, Sodium Selenite, Insulin, TGFβ1 (R&D), NODAL, BMP4, Wnt/B-Catenin, Pluripotin, Glucogen synthetase kinase-3 inhibitor, CHIR99021, PD0325901, 6-Bromoindirubib-3-oxime (BIO), KSOR, vitamin A, histone deacetylase inhibitor (HDAC), RG 108, R(+)BayK8644, SB431542, thiazovivin, BIX01294, Fibroblast growth factor 2 (FGF2), Activin A, Wnt3a, L-Ascorbic Acid, Cyclic Pifithrin-α, Tranylcypromine hydrochloride, Kenpaullone, 5-Azacytidine, Valproic Acid (VPA), Theanine. |
| Ectoderm-like Cells | a retinoid compound (ex. ATRA), L-Ascorbic acid, sonic hedgehog (SHH), Wnt 3a, a neurotrophic factor, FGF2, Epidermal growth factor (EGF), Transforming growth factor (TGF) alpha, Estrogen, Noggin, 5-Azacytidine, VPA, BIX01294, R(+)BayK8644, RG108, Butyric acid, Lithium, Cytosine arabinoside, Chordin, b-Catenin, CHIR99021, SB431542, rapamycin (mTOR). |
| Mesendoderm-like Cells | BIO, Dorsomorphin, vitamin E, VPA, HAS, Bone morphogenetic protein 4 (BMP4), EGF, FGF2, CHIR99021, Activin A, Insulin-like growth factor 1 (IGF-1), SB431542, PD0325901, Butyric acid, Epidermal growth factor-Cripto/FRL-1/Cryptic (EGF-CFC) and the TGFβs, Nodal, SHH, Vg1/GDF1 (growth and differentiation factor-1). |
| Neural Stem-like cells | a retinoid compound (ex. ATRA), a neurotrophic factor, L-Ascorbic acid, Estrogen, 5-Azacytidine, VPA, BIX01294, R(+)BayK8644, RG108, Butyric acid, Lithium, Activin A, Noggin, EGF, FGF2, Wnt3a, TGF, cAMP, Follistatin, SHH, BDNF, IGF-1, CNTF, PDFG, SDNSF/MCFD2, Neuropeptide Y, Forskolin. |
| Cardiac Stem-like cells | Wnt1, Cardiogenol C, BMP4, FGF2, Activin A, VEGF, DKK1 (dickkopf homologue 1), Insulin-like growth factor 1 (IGF-1), Oxytocin, Cardiotropin, Hepatocyte growth factor (HGF), 5-Azacytidine, L-3,3',5-triiodothyronine, Valproic Acid, BIX01294, |

TABLE B-continued

| Desired cell type | Reprogramming Factor |
| --- | --- |
| | R(+)BayK8644, RG108, Cardiogenol C hydrochloride, Butyric acid, Stem Cell factor. |
| Pancreatic Progenitor-like Cells | Activin A, GLP-1 , FGF2, Reg1, nicotanamide, Betacellulin, SHH, (−)-Indolactam V, a retinoid compound, Cyclopamine, IDE-1 and 2,5-Azacytidine, Valproic Acid, BIχ01294, R(+)BayK8644, RG108, Butyric acid. |
| Hematopoietic Stem-like Cells | SCGM, Thrombopoietin, Interleukin-3, Stem Cell factor (SCF), GM-CSF, Interleukin-6, SHH, Wnt5a, Insulin-like Growth factor, Angiopoietin factor 2 or 3, butyric acid, 5-Azacytidine, estrogen. |
| Myogenic Stem-like Cells | HGF, FGF2, IGF, BMP-2, TGFβ, TGFβ3, Wnt3a, Wnt11, 5-Azacytidine, Valproic Acid, BIX01294, R(+)BayK8644, RG108, Trichostatin A (TSA), retinoic acid, Lithium, Butyric acid. |

According to the principles of the invention, increasing intracellular levels of at least one reprogramming agent should induce a direct or indirect endogenous expression of at least one gene regulator. As used herein, "gene regulator" refers to a polynucleotide or polypeptide whose expression is associated with a series of intracelluar events leading to the transformation of a given cell of a first type into a pluripotent, multipotent and/or unipotent cell. Typically expression of a gene regulator directly or indirectly activates genes necessary for the phenotypical and functional characteristic of pluripotent, multipotent and/or unipotent cells, while repressing genes of the cell of a first type. The gene regulator may be the same or be different than the reprogramming agent. Examples of gene regulators according to the invention include, but are not limited to, the polynucleotides and polypeptides listed herein before in TABLE A.

In some embodiments, the gene regulator is a polypeptide which shares at least 75%, 80%, 85%, 90%, 95%, 97%, 99% or more of the functionality or sequence identity of any one of the gene regulators provided in the Table A hereinbefore.

As used herein, "conditions supporting growth" or "conditions supporting the transformation" when referring to a desired cell refers to various suitable culture conditions (temperature, pH, $O_2$ tension, osmolarity, cell media, factors, compounds, growth substrate (ex. laminin, collagen, fibronectin, Matrigel™, low-bind surface, nanostructured or charged surface, etc.), 3D environment, etc.) favoring growth of the desired cell type and/or favoring transformation towards such desired cell type. Those skilled in the art know that growth or transformation of particular cell types is stimulated under specific conditions, while inhibited by others, and it is within their skill to select suitable conditions (e.g. culture conditions) favoring growth or transformation of desired cell types.

The terms "phenotypical and functional properties", when referring to a desired cell or to an embryonic stem cell, means the biological, biochemical, physiological and visual characteristics of a cell, including expression of certain genes and cell surface markers, which can be measured or assessed for confirming its identity or function(s).

An example of a suitable reprogramming, agent according to preferred embodiments of the invention is MUSASHI1. In some embodiments this polypeptide is preferred for driving a first cell, such as a fibroblast, into a Neural Stem-Like Cell (NSLC). In other embodiments, the at least one reprogramming agent which said intracellular levels is increased is (are) either Musashi1 (Msi1) alone; Musashi1 (Msi1) and Neurogenin 2 (Ngn2); Musashi1 (Msi1) and methyl-CpG binding domain protein 2 (MBD2); or Neurogenin 2 (Ngn2) and methyl-CpG binding domain protein 2 (MBD2). Adequate intracellular levels of these polypeptides are preferred since they tend to be expressed throughout an entire cell lineage, from as early as embryonic stem cells (or even earlier) to pre-somatic cells (or even later).

MBD2 is a member of a family of methyl-CpG-binding proteins that has been reported to be both a transcriptional repressor and a DNA demethylase (dMTase). As used herein, the term "MBD2" generally refers to the human methyl-CpG binding domain protein 2. The GeneBank™ (NCBI) accession number of human MBD2 is NM_003927.3/AF072242, the UniProt™ accession number is NP-003918/Q9UBB5 and the UniGene™ accession number is Hs.25674.

As used herein, the term "Msi1" generally refers to the human musashi homolog 1. The GeneBank™ (NCBI) accession number of human Msi1 is NM_002442.2/AB012851, the UniProt® accession number is NP-002433/O43347 and the UniGene™ accession number is Hs.158311.

As used herein, the term "Ngn2" generally refers to the human neurogenin 2. The GeneBank® (NCBI) accession number of human Ngn2 is NM_024019.2/BC036847, the UniProt™ accession number is NP-076924/Q9H2A3 and the UniGene™ accession number is Hs.567563.

According to additional aspects, the method of transforming a cell of a first type to a desired cell of a different type comprises the steps of either.

1) contacting the cell of a first type with one or more compounds capable of increasing intracellular levels of at least one reprogramming agent within the cell and directly or indirectly remodeling the chromatin and/or DNA of the cell; or 2) contacting the chromatin and/or DNA of a cell of a first type with an agent capable of remodeling the chromatin and/or DNA of the cell; and increasing intracellular levels of at least one reprogramming agent.

According to various embodiments, step 2) may be carried out consecutively to step 1), simultaneously with step 1), or before step 1).

According to a particular aspect, the invention relates to a method for obtaining a particular stem-like cell, comprising:

providing a cell of a first type;

contacting chromatin and/or DNA of a cell of a first type with a histone acetylator, an inhibitor of histone deacetylation, a DNA demethylator, and/or a chemical inhibitor of DNA methylation; and increasing intracellular levels of at least one gene regulator for that particular stem-like cells, wherein the gene regulator is capable of driving directly or indirectly transformation of the cell of the first type into the particular stem-like cell.

According to a particular aspect, the invention relates to a method for obtaining a Neural Stem-Like Cell (NSLC), comprising:

providing a cell of a first type which is not a NSLC;

increasing intracellular levels of at least one neural stem cell specific polypeptide, wherein the polypeptide is capable of driving directly or indirectly transformation of the cell of the first type into a NSLC; and contacting chromatin and/or DNA of a cell of a first type with a histone acetylator, an inhibitor of histone deacetylation, a DNA demethylator, and/or a chemical Inhibitor of DNA methylation.

With respect to the second step, the term "remodelling the chromatin and/or DNA" refers to dynamic structural changes to the chromatin. These changes can range from local changes necessary for transcriptional regulation, to global changes necessary for opening up the chromatin structure or chromosome segregation to allow transcription of the new set of genes characteristic of the desired cell of a different type, to closing up of the chromatin structure or chromosome segregation to prevent transcription of certain genes that are not characteristic of the desired cell of a different type. In some embodiments, opening up of the chromatin structure refers more specifically to acetylation of histones, and demethylation of DNA, while closing up of the chromatin structure refers more specifically to deacetylation of histones, and methylation of DNA.

As used herein, "compound" refers to a compound capable of effecting a desired biological function. The term includes, but is not limited to, DNA, RNA, protein, polypeptides, and other compounds including growth factors, cytokines, hormones or small molecules. As used herein, compounds capable of remodeling chromatin and/or DNA include, but are not limited to, histone acetylators, inhibitors of histone deacetylation, DNA demethylators, inhibitors of DNA methylation and combination thereof.

"Inhibitor of DNA methylation" refers to an agent that can inhibit DNA methylation. DNA methylation inhibitors have demonstrated the ability to restore suppressed gene expression.

Suitable agents for inhibiting DNA methylation include, but are not limited to 5-azacytidine, 5-aza-2-deoxycytidine, 1-β-D-arabinofuranosil-5-azacytosine, and dihydro-5-azacytidine, and zebularine (ZEB), BIX (histone lysine methyltransferase inhibitor), and RG108.

"Inhibitor of histone deacetylation" refers to an agent that prevents the removal of the acetyl groups from the lysine residues of histones that would otherwise lead to the formation of a condensed and transcriptionally silenced chromatin. Histone deacetylase inhibitors fall into several groups, including: (1) hydroxamic acids such as trichostatin (A), (2) cyclic tetrapeptides, (3) benzamides, (4) electrophilic ketones, and (5) aliphatic acid group of compounds such as phenylbutyrate and valporic acid. Suitable agents to Inhibit histone deacetylation include, but are not limited to, valporic acid (VPA), phenylbutyrate Trichostatin A (TSA), Na-butyrate, and benzamides. VPA promotes neuronal fate and inhibits glial fate simultaneously through the induction of neurogenic transcription factors including NeuroD.

"Histone Acetylator" refers to an agent that inserts acetyl groups to the lysine residues of histones that opens up the chromatin and turns it into a transcriptionally active state. Suitable Histone Acetylator agents include, but are not limited to, Polyamine, CREB (cAMP element binding protein), and BniP3.

"DNA demethylator" refers to an agent that removes the methyl groups from DNA and possesses the ability to Inhibit hypermethylation and restore suppressed gene expression. A demethylase is expected to activate genes by removing the repressive methyl residues. Suitable DNA demethylators include, but are not limited to, MBD2 and Gadd45b.

In some embodiments, the reprogramming agent has one or more of the following functions: it decrease the expression of one or more markers of cells of the first type (ex. see Table C), and/or increase the expression of one or more markers of the desired cell of the different type (ex. see Table A). Cells that exhibit a selectable marker for the desired cell of a different type are then selected and assessed for characteristics of the desired cell of a different type.

According to the invention, transformation into the desired cell results in stable expression of a plurality of secondary genes whose expression is characteristic of phenotypical and/or functional properties of the desired cell. Genes whose expression is characteristic of phenotypical and/or functional properties of the desired cell include, but is not limited to, those listed in Table A.

In some embodiments, expression of secondary genes whose expression is characteristic of phenotypical and functional properties of the desired cell results in the expression of markers defined according to Table A or the following table:

| Desired cell type | Markers |
| --- | --- |
| Neural stem-like cells | Nestin, Sox2, GFAP, Msi1 |
| Neural-like cells | βIII-tubulin, Map2b, Synapsin, ACHE |
| Ectoderm-like cells | Sox2, Sox1, Zic1, Nestin, Notch 1, FoxJ3, Otx2, Cripto1, Vimentin |
| Mesendoderm-like cells | Sox17, FoxA2, CXCR4, GATA4, Mixl1, Eomesodermin |
| Pluripotent-like cells | Oct4, SSEA4, TRA-1-60, TRA-1-81, AP |

In some embodiments, transformation of a cell of a first type into the desired cell results in a stable repression of a plurality of genes typically expressed in the cell of the first type but not in the desired cell of the different type. Examples of such suppressed genes include, but are not limited to, those defined in Table C:

TABLE C

Examples of suppressed genes

Cell-type specific genes typically repressed during Reprogramming

| Cell Type | Name | RefSeq/ GenBank™ (NCBI) Accession No. | UniProt™/ Swiss-Prot Accession No. | UniGene™ Accession No. | Markers |
|---|---|---|---|---|---|
| Keratinocytes | TP63, isoform 1 | NM_003722.4 | Q9H3D4 | Hs.137569 | Keratin 14 |
| | TP63, isoform 2 | NM_001114978.1 | Q9H3D4 | Hs.137569 | Basonuclin |
| | TP63, isoform 3 | NM_001114979.1 | Q9H3D4 | Hs.137569 | P63 |
| | TP63, isoform 4 | NM_001114980.1 | Q9H3D4 | Hs.137569 | |
| | TP63, isoform 5 | NM_001114981.1 | Q9H3D4 | Hs.137569 | |
| | TP63, isoform 6 | NM_001114982.1 | Q9H3D4 | Hs.137569 | |
| | BNC1 | NM_001717.3 | Q01954 | Hs.459153 | |
| | BCN2 | NM_017637.5 | Q6ZN30 | Hs.656581 | |
| | KRT14 | NM_000526.4 | P02533 | Hs.654380 | |
| | Involucrin | NM_005547.2 | P07476 | Hs.516439 | |
| Fibroblasts | THY1 | NM_006288.3 | P04216 | Hs.724411 | Col5A2 |
| | FBN2 | NM_001999.3 | P35556 | Hs.519294 | Fibronectin |
| | COL5A2 | NM_000393.3 | P05997 | Hs.445827 | |
| | DNMT1, isoform a | NM_001130823.1 | P26358 | Hs.202672 | |
| | DNMT1, isoform b | NM_001379.2 | P26358 | Hs.202672 | |
| CD34+ | Isl1 | NM_002202.2 | P61371 | Hs.505 | VEGFR |
| | HOXA9 | NM_152739.3 | P31269 | Hs.659350 | Cytokeratin |
| | HOXB4 | NM_024015.4 | P17483 | Hs.664706 | |
| | Klk-1 | NM_002257.2 | P06870 | Hs.123107 | CD34 |
| | Bry | NM_003181.2 | O15178 | Hs.389457 | |
| Adipose-derived stem cells (ADSC) | ALCAM | NM_001627.2 | Q13740 | Hs.591293 | ALBO |
| | VCAM-1 | NM_001078.2 | P19320 | Hs.109225 | Adiponectin |
| | VCAM-1, isoform b | NM_080682.1 | P19320 | Hs.109225 | |
| | PROM1, isoform 1 | NM_006017.2 | O43490 | Hs.614734 | Leptin |
| | PROM1, isoform 2 | NM_001145847.1 NM_001145848.1 | O43490 | Hs.614734 | |
| | PROM1, isoform 4 | NM_001145852.1 | O43490 | Hs.614734 | |
| | PROM1, isoform 5 | NM_001145851.1 | O43490 | Hs.614734 | |
| | PROM1, isoform 6 | NM_001145850.1 | O43490 | Hs.614734 | |
| | PROM1, isoform 7 | NM_001145849.1 | O43490 | Hs.614734 | |
| | FUT4 | NM_002033.3 | P22083 | Hs.390420 | |

In preferred embodiments, stable repression of any one or more of the genes listed in Table C being expressed in the first cell type is also characterized by a disappearance of the corresponding markers (see Table C).

Those skilled in the art will understand that there exist many alternative steps for facilitating cell reprogramming. Additional steps for facilitating cell reprogramming include destabilizing the cell's cytoskeletal structure (for example, by exposing the cell to cytochalasin B), loosening the chromatin structure of the cell (for example, by using agents such as 5 azacytidine (5-Aza) and Valproic acid (VPA) or DNA demethylator agents such as MBD2), transfecting the cell with one or more expression vector(s) containing at least one cDNA encoding a neurogenic transcription factor (for example, Msi1 or Ngn2), using an appropriate medium for the desired cell of a different type and an appropriate differentiation medium to induce differentiation commitment of the desired cell of a different type, inhibiting repressive pathways that negatively affects induction into commitment into the desired cell of a different type, growing the cells on an appropriate substrate for the desired cell of a different type (for example, laminin for NSLCs or a low-bind surface for culturing floating neurospheres), and growing the cells in an environment that the desired cell of a different type (or "-like" cell) would be normally exposed to in vivo such as the proper temperature, pH and low oxygen environment (for example about 2-5% $O_2$). In various embodiments, the invention encompasses these and other related methods and techniques for facilitating cell reprogramming.

Accordingly, the method of transforming a cell of a first type into a cell of a second different type may comprise additional facultative steps. In one embodiment, the method of transforming a cell further comprises the step of pretreating the cell of a first type with a cytoskeleton disruptor. As used herein "cytoskeleton" refers to the filamentous network of F-actin, Myosin light and heavy chain, microtubules, and intermediate filaments (IFs) composed of one of three chemically distinct subunits, actin, tubulin, or one of several classes of IF protein, as well as the cell's cytoskeletal structure including the cell membrane and portions of the cell cytoplasm and integrated organelles and components. This also refers to other structures and molecules that are directly or indirectly part of or affected by the cytoskeleton. Accordingly, the term "cytoskeleton disruptor" refers to any molecule, compound or process that can inhibit, disrupt, remove or affect the cell cytoskeleton to destabilize the cell and consequently remove or change the feedback mechanisms between the cell's shape and cellular and nuclear function (thus removing or changing the cell's memory). Suitable cytoskeleton disruptors according to the invention include, but are not limited to, the cytochalasin family of actin cytoskeleton inhibitors, such as Cytochalasin B or D, microtubule inhibitors such as colchicine, and myosin inhibitors such as 2,3-butanedione monoxime; physical effects include freezing, low osmolarity of the medium resulting in osmotic build up within the cell and bursting and disruption (or removal) of cell membrane and cell cytoskeleton, and other forms of removal of the cell's physical memory. Such pretreatment may boost reprogramming. In a preferred embodiment, the cell is cultured in the presence of at least one cytoskeleton inhibitor one day before, during, or after introducing a neurogenic transcription factor(s).

Placing the cell in conditions for supporting the transformation of the desired cell, and/or maintaining the cell in culture conditions supporting the transformation of the desired cell may comprise culturing the cell in a media comprising one or more factors appropriate for inducing the expression of the morphological and functional characteristics of the desired cell of a different type. In some embodiments the one or more factors are reprogramming factors helpful in reprogramming a cell and these reprogramming factors can be used alone or in combinations.

In other embodiments, the step of culturing the cell in a media comprising one or more factors appropriate for inducing the expression of the morphological and functional characteristics of the desired cell of a different type is carried out subsequently or simultaneously to steps iii) or iv), or subsequently or simultaneously to steps 1) or 2), as defined hereinbefore.

Those skilled in the art know many different types of media and many reprogramming factors that may be helpful in reprogramming a cell and these reprogramming factors can be used alone or in combinations. In various embodiments, the reprogramming factor is selected according to TABLE B.

In some embodiments, reprogramming factors have one or more of the following functions: decrease the expression of one or more markers of the first type of cell and/or increase the expression of one or more markers of the desired cell. Cells that exhibit a selectable marker for the desired cell are then selected and assessed for unipotency, multipotency, pluripotency, or similar characteristics (as appropriate).

In particular embodiments, the cells are cultured in serum-free medium before, during or after any one of steps i) to iv) as defined hereinbefore, or during or after steps 1) or 2), as defined hereinbefore.

In some embodiments, Mesendoderm-like cells can be created from cells such as ADSCs by up-regulating the expression of FoxD3, Mixl1, Ngn3 and MBD2. Additionally up-regulating the expression of Oct4, Sox17, Brachyury, and/or FoxA2 can be used to create Mesendoderm-like cells. In addition, media compositions detailed in Table 37 can be used to create mesendoderm-like cells from adipocyte-derived stem cells (ADSCs) and similar cells, along with the use of proper cell substrates for mesendoderm cells known in the art (e.g., gelatin-coated plates).

In some embodiments, cells such as ADSCs can be reprogrammed into pancreatic progenitor-like cells and ß islet-like cells by up-regulating the expression of Sox17, Pdx1, Ngn3, and Oct4 (e.g., Oct4+Sox17+Pdx1+Ngn3; Sox17+Pdx1+Ngn3; Oct4+Pdx1+Ngn3). Additionally up-regulating the expression of FoxA2 and MBD2 can be used to create these cells. In addition, media compositions detailed in Table 39 can be used to create pancreatic progenitor-like cells and ß islet-like cells from adipocyte-derived stem cells (ADSCs) and similar cells, along with the use of proper cell substrates for growing pancreatic progenitor cells and ß islet-like cells known in the art (e.g., fibronectin-coated collagen gels).

In some embodiments, cells such as ADSCs or mesenchymal stem cells (MSCs) can be reprogrammed into cardiac stem-like cells and mesoderm-like cells by up-regulating the expression of a combination of Mesp1, FoxD3, Tbx5, Brachyury (T), Nkx2.5, Sox17 and/or Gata4 (e.g., Foxd3+Sox17+Mesp1+Tbx5; Foxd3+Sox17+Mesp1+Nkx2.5; Foxd3+T+Mesp1+Gata4, T+Mesp1+Nkx2.5, T+Mesp1+Tbx5), which increase the expression of mesoderm and cardiac stem cell markers. Additionally up-regulating the expression of Gata6 and Baf60c can be used to create these cells. In addition, media compositions detailed in Table 44 can be used to create cardiac stem-like cells from adipocyte-derived stem cells (ADSCs) or mesenchymal stem cells (MSCs) and similar cells, along with the use of proper cell substrates for growing cardiac stem cells known in the art (e.g., matrigel, gelatin, or laminin). In some embodiments, cells such as ADSCs can be reprogrammed into pluripotent-like stem cells up-regulating the expression of Rex1, Oct4 and Klf4, or Sall4, Oct4, Klf4 and Nanog. Reprogramming by transient transfection of a combination of the above genes can be achieved efficiently. These cells can be differentiated into ectoderm-like cells, endoderm-like cells, or mesenderm-like cells by methods known in the art for differentiating pluripotent stem cells into these lineages. In addition, these pluripotent-like stem cells have protective and/or therapeutic/regenerative effect on other cells (e.g., hepatocytes).

The NSLCs that is a subject of this invention have benefits over native human neural stem/progenitor cells as well as embryonic stem cells. The NSLCs do not readily form tumors or teratomas (as tested in NOD-SCID mice), can be created from easily obtainable somatic cells (e.g., fibroblasts, CD34+ blood cells, keratinocytes) and differentiated towards any specific neuronal lineage, express neurotrophic growth factors (e.g., BDNF and GDNF), express some neuronal differentiation genes while maintaining a stem cell like state allowing a higher proportion of neuronal differentiation when placed in differentiation conditions (compared to native human neural stem/progenitor cells), form functional gap junctions and readily form synapses, and are capable of attaching and surviving on 3D scaffolds and environments.

The stem-like cells of the present invention have numerous advantages over the prior art such as efficient reprogramming without gene integration or constant artificial forced gene expression, greater potency and safety over native cells (esp. stem/progenitor cells), and having the capability to be the cell of interest for a particular application (e.g., a neural stem-like cell for CNS applications; a cardiac stem-like cell for cardiac applications, a pancreatic progenitor-like cells or ß islet-like cells for diabetes, an ectoderm-like cell, a mesoderm-like cells, an endoderm-like cell, etc.). In addition derived cells of the invention can be a relatively homogeneous population of autologous cells of a particular phenotype of interest.

The methods of the present invention allow the ability to create the native types of stem cells for particular applications (e.g., neural stem-like cells for CNS applications; cardiac stem-like cells for cardiac applications, pancreatic progenitor-like cells or ß-like cells for diabetes, etc.) as well as creating autologous (from the patients own cells) versions of these stem cells that allow them to graft more appropriately when delivered to the patient as a treatment or for augmenting the health or functionality of a particular tissue or organ, or for diagnostic purposes. The cells can also be used for modeling (e.g., disease modeling, or testing the effects of particular compounds or other molecules (e.g., for personalized medicine purposes)). The cells can also easily be enhanced by specific genes of interest or a defective gene repaired/replaced before delivery to the patient for treatment of a genetic disorder or for enhanced therapeutic value or augmenting the health or functionality of a particular cell, tissue, organ, system, or organism.

Obtaining Neural Stem-Like Cells (NSLCs)

According to preferred embodiments for creating Neural Stem-Like Cells (NSLCs), the methods of the invention are carried out such that cells are treated with selected agents, compounds and factors to promote the reprogramming and/or dedifferentiation towards Stem-Like Cells (SLCs). Such reprogrammed somatic cells can then be further treated with agents and/or cultured under conditions suitable for promoting reprogramming towards Neural Stem-Like Cells (NSLCs), and expansion of the NSLCs for the long-term. NSLCs according to the invention have the potential to differentiate to neuronal-like and/or glial-like cells, as well as neuronal and/or glial cells, for potential treatment of neurological diseases and injuries such as Parkinson's disease and spinal cord injury. The methods described herein are also useful for producing histocompatible cells for cell therapy.

Accordingly, some aspects of the present invention relates to generating neurons from an Individual patient, thus making autologous transplantations possible as a treatment modality for many neurological conditions including neurotrauma, stroke, neurodegenerative diseases such as Multiple Sclerosis, Parkinson's disease, Huntington disease, Alzheimer's diseases. Thus, the invention provides for neurological therapies to treat the disease or trauma of interest.

Therefore, another aspect of the invention concerns a method of obtaining a Neural Stem-Like Cell (NSLC), comprising either
1) contacting the cell of a first type with one or more neural stem cell regulating polypeptide capable of increasing intracellular levels of neural stem cell specific polypeptides within said cell and directly or indirectly remodeling the chromatin and/or DNA of the cell and driving directly or indirectly transformation of the cell of the first type into a NSLC; or
2) contacting the chromatin and/or DNA of a cell of a first type with a histone acetylator, an inhibitor of histone deacetylation, a DNA demethylator, and/or an inhibitor of DNA methylation; and increasing intracellular levels of at least one neural stem cell specific polypeptide driving directly or indirectly transformation of the cell of the first type into a NSLC.

In preferred embodiments, the step 1) comprises increasing intracellular levels of a MUSASHI1 polypeptide. As it will be explained hereinafter this can be achieved by different means Including, but not limited to, transient expression of the MUSASHI1 polypeptide, preferably by transfecting an expression vector encoding the polypeptide.

In preferred embodiments, the step 2) comprises increasing intracellular levels of a MBD2 polypeptide or treating the cells with VPA and 5-AZA. As it will be explained hereinafter this can be achieved by different means including, but not limited to, transient expression of the MBD2 polypeptide, preferably by transfecting an expression vector encoding the polypeptide(s), and/or pre-treating and/or treating the cells with VPA and 5-AZA.

In one particular embodiment, reprogramming a cell of a first type to another type of cell that exhibits at least two selectable markers for neural stem cells requires transfecting the cell of a first type with one vector containing a cDNA encoding for a neurogenic transcription factor and one DNA demethylator. To enhance the de-differentiation the cells are exposed or pre-exposed to an agent(s) that inhibits DNA methylation, inhibits histone deacetylation, and/or disrupts the cell cytoskeleton. For example, the dedifferentiation can be enhanced by pre-treating the cells with an agent that disrupts the cell cytoskeleton followed by transfecting the cells with one or more vector(s) containing two neurogenic transcription factors in the presence of a DNA demethylator and/or inhibitor of DNA methylation and histone deacetylation. The histone deacetylator, inhibitor of histone deacetylation, DNA demethylator, and/or an inhibitor of DNA methylation are as defined previously.

As defined previously, the method may further comprise a preliminary step of pre-treating the cell of a first type with a cytoskeleton disruptor, as defined previously, and/or culturing the cell in a media comprising one or more reprogramming factors appropriate for appearance and maintenance of the morphological and functional characteristics of NSLCs as defined previously (e.g. a retinoid compound, a neurotrophic factor, bFGF, EGF, SHH, Wnt 3a, neuropeptide Y, Estrogen). In some embodiment the method further comprises inhibiting cellular BMP signaling pathways (e.g. by NOGGIN, fetuin, or follistatin).

In preferred embodiments, generation of a NSLC from a first cell comprises the use of one or more reprogramming agents. Suitable agents include, but are not limited to, Musashi-1 (Msi1) and Neurogenin 2 (Ngn2). Other potential agents are listed in Table A and B.

The present invention is also directed to the use of DNA expression vectors encoding a protein or transcript which upregulates the expression of neurogenesis. The genetically-engineered DNA sequence, encoding a defined reprogramming agent such as Msi1 and Ngn2, can be introduced into cells by using a mono-, bi-, or poly-cistronic vectors. The expression of an endogenous multipotency gene indicates that the cDNA encodes a protein whose expression in the cell result directly or indirectly in the de-differentiation of the cell. The newly de-differentiated mammalian cells are capable of re-differentiating to neuronal lineages to regenerate said mammalian cells, tissues, and organs.

The present invention is further directed to a method for generating NSLCs by introducing a genetically-engineered DNA sequence into human somatic cells via transient transfection. Since the DNA Introduced in the transfection process is not inserted into the nuclear genome, the foreign DNA decreases over time and when the cells undergo mitosis. Nonviral vectors remain in a non-replicative form, have low immunogenicity, and are easy and safe to prepare and to use. Furthermore, plasmids may accommodate large fragments of DNA.

In one particular embodiment, the method starts with obtaining cells from the individual, and reprogramming the cells in vitro to generate NSLCs. The significant aspect of the present invention is the stable reprogramming of a somatic cell or non-neuronal cell into a NSLC that can give rise to different types of, neuronal or glial cells (including neuronal-like or glial-like cells), as well as neural crest derived cells such as cardiomyocytes. These can then be implanted back into the same patient from which the cells were obtained, thus making an autologous treatment modality for many neurological conditions including neurotrauma, stroke, and neurodegenerative disease possible, as well as cardiac conditions such as myocardial infarction. These can also be implanted into a different individual from which the cells were obtained. Accordingly, the cells and methods of the present invention may be helpful to treat, prevent, or to stabilize a neurological disease such as Alzheimer's disease, Parkinson's disease, multiple sclerosis, or spinal cord injury, or a cardiac disease such as myocardial infarction. This technology provides an ample source of neural stem cells, neuro-progenitor cells, neurons and glia, as well as neural crest derived cells, for clinical treatment, which can be performed by implantation of NSLCs in vivo or inducing the differentiation in vitro and implantation of neuro-progenitor cells or specific neurons or glia in vivo.

In another embodiment, the method comprises isolating somatic or non-neuronal cells and exposing the cells to one or more agents that alter cell morphology and chromatin structure, and transfecting the cells with one or more genes containing at least one cDNA encoding for a neurogenic transcription factor. The gene transfection step may be replaced with alternative agents that induce the expression of the neurogenic transcription factor(s) in the cell. Inducing epigenetic modifications to DNA and histones (especially DNA demethylation and an open chromatic structure) facilitate true reprogramming of the cells. In another embodiment, the cells are incubated in a low oxygen environment, for example 5% $O_2$, thereby helping in reprogramming the cells.

This methodology allows the reprogramming of a cell into a NSLC. The further course of development and the expansion of the reprogrammed cell depend on the in situ environment cues to which it is exposed. The embodiments of the invention further include growing the reprogrammed cell in an appropriate proliferation medium to expand the generated NSLC, for example Neural Progenitor proliferation Medium (StemCell Technologies) with the presence of epidermal growth factor (EGF) and basic fibroblast growth factor (bFGF), to promote the neural stem cell to proliferate.

The NSLCs obtained according to the invention can be differentiated into neuronal, astrocyte, and/or oligodendrocyte lineages in appropriate differentiation medium, for example NS-A differentiation medium (StemCell, Technologies) or NbActive medium (BrainBits™) including a retinoid compound, such as all-trans-retinoic acid or vitamin A, and BDNF, to induce the differentiation of NSLCs towards neuronal and/or glial cells. Neuronal cells include cells that display one or more neural-specific morphological, physiological, functional and/or immunological features associated with a neuronal cell type. Useful criteria features includes: morphological features (e.g., long processes or neurites), physiological and/or immunological features such as expression of a set of neuronal-specific markers or antigens, synthesis of neurotransmitter(s) such as dopamine or gamma aminobutyric acid (GABA), and functional features such as ion channels or action potentials characteristic of neurons.

In accordance with the method, reprogrammed cells can be selected based on differential adherence properties as compared to untransfected cells; for example, reprogrammed cells can form floating neurospheres or grow well on laminin while untransfected fibroblasts attach and grow well on regular cell culture treated plates. Reprogrammed cells include cells that exhibit one or more neural stem specific markers and morphology and the loss of some or all of the specific markers related to the original cells. Furthermore, some of the functionality of the neural-like cells (NLCs) can be assessed at different time points by, for example, patch-clamping, immunostaining for synaptophysin and MAP2b, and by immunochemical means such as by enzyme-linked immunosorbent assay (ELISA).

In certain embodiments, the present invention provides NSLCs that are able to initiate and direct central nervous system regeneration at a site of tissue damage and can be customized for individual patients using their own cells as the donor or starting cell. The present invention can be used to generate cells from an individual patient, thus making autologous transplantations possible as a treatment modality for many neurological conditions. Thus, this technology eliminates the problems associated with transplantations of non-host cells, such as, immunological rejection and the risk of transmitted disease. The great advantage of the present invention is that it provides an essentially limitless supply for autologous grafts suitable for transplantation. Therefore, it will obviate some significant problems associated with current source of materials and methods of transplantation.

Delivery of Polynucleotides

In certain embodiments, the invention concerns the use of polynucleotides, e.g. a polynucleotide encoding a MBD2 polypeptide, a MUSASHI1 polypeptide and/or a Ngn2 polypeptide. Means for introducing polynucleotides into a cell are well known in the art. Transfection methods of a cell such as nucleofection and/or lipofection, or other types of transfection methods may be used. For instance a polynucleotide encoding a desired polypeptide can be cloned into intermediate vectors for transfection in eukaryotic cells for replication and/or expression. Intermediate vectors for storage or manipulation of the nucleic acid or production of protein can be prokaryotic vectors, (e.g., plasmids), shuttle vectors, insect vectors, or viral vectors for example. A desired polypeptide can also be encoded by a fusion nucleic acid.

To obtain expression of a cloned nucleic acid, it is typically subcloned into an expression vector that contains a promoter to direct transcription. Suitable bacterial and eukaryotic promoters are well known in the art and described, e.g., in Sambrook and Russell (Molecular Cloning: a laboratory manual, Cold Spring Harbor Laboratory Press). The promoter used to direct expression of a nucleic acid of choice depends on the particular application. For example, a strong constitutive promoter is typically used for expression and purification. In contrast, when a dedifferentiation protein or Compound is to be used in vivo, either a constitutive or an inducible promoter or compound is used, depending on the particular use of the protein. In addition, a weak promoter can be used, such as HSV TK or a promoter having similar activity. The promoter typically can also include elements that are responsive to transactivation, e.g., hypoxia response elements, Ga14 response elements, lac repressor response element, and small molecule control systems such as tet-regulated systems and the RU-486 system.

In addition to a promoter, an expression vector typically contains a transcription unit or expression cassette that contains additional elements required for the expression of the nucleic acid in host cells, either prokaryotic or eukaryotic. A typical expression cassette thus contains a promoter operably linked, e.g., to the nucleic acid sequence, and signals required, e.g., for efficient polyadenylation of the transcript, transcriptional termination, ribosome binding, and/or translation termination. Additional elements of the cassette may include, e.g., enhancers, and heterologous spliced intronic signals.

Expression vectors containing regulatory elements from eukaryotic viruses are often used in eukaryotic expression vectors, e.g., SV40 vectors, papilloma virus vectors, and vectors derived from Epstein-Barr virus. Other exemplary eukaryotic vectors include pMSG, pAV009/A+, pMTO10/A+, pMAMneo-5, baculovirus pDSVE, and any other vector allowing expression of proteins under the direction of the SV40 early promoter, SV40 late promoter, metallothionein promoter, murine mammary tumor virus promoter, Rous sarcoma virus promoter, polyhedrin promoter, or other promoters shown effective for expression in eukaryotic cells.

Standard transfection methods can be used to produce bacterial, mammalian, yeast, insect, or other cell lines that express large quantities of dedifferentiation proteins, which can be purified, if desired, using standard techniques. Transformation of eukaryotic and prokaryotic cells is performed according to standard techniques.

Any procedure for introducing foreign nucleotide sequences into host cells can be used. These include, but are not limited to, the use of calcium phosphate transfection, DEAE-dextran-mediated transfection, polybrene, protoplast fusion, electroporation, lipid-mediated delivery (e.g., liposomes), microinjection, particle bombardment, introduction of naked DNA, plasmid vectors, viral vectors (both episomal and integrative) and any of the other well known methods for introducing cloned genomic DNA, cDNA, synthetic DNA or other foreign genetic material into a host cell (see, e.g., Sambrook et al., supra). It is only necessary that the particular genetic engineering procedure used be capable of successfully introducing at least one gene into the host cell capable of expressing the protein of choice.

Conventional viral and non-viral based gene transfer methods can be used to Introduce nucleic acids into mammalian cells or target tissues. Such methods can be used to administer nucleic acids encoding reprogramming polypeptides to cells in vitro. Preferably, nucleic acids are administered for in vivo or ex vivo gene therapy uses. Non-viral vector delivery systems include DNA plasmids, naked nucleic acid, and nucleic acid complexed with a delivery vehicle such as a liposome. Viral vector delivery systems include DNA and RNA viruses, which have either episomal or integrated genomes after delivery to the cell.

Methods of non-viral delivery of nucleic acids include lipofection, microinjection, ballistics, virosomes, liposomes, immunoliposomes, polycation or lipid-nucleic acid conjugates, naked DNA, artificial virions, and agent-enhanced uptake of DNA. Lipofection reagents are sold commercially (e.g., Transfectam® and Lipofectin®). Cationic and neutral lipids suitable for efficient receptor-recognition lipofection of polynucleotides are known. Nucleic acid can be delivered to cells (ex vivo administration) or to target tissues (In vivo administration). The preparation of lipid:nucleic acid complexes, including targeted liposomes such as immunolipid complexes, is well known to those of skill in the art.

The use of RNA or DNA virus-based systems for the delivery of nucleic acids take advantage of highly evolved processes for targeting a virus to specific cells in the body and trafficking the viral payload to the nucleus. Viral vectors can be administered directly to patients (in vivo) or they can be used to treat cells in vitro, wherein the modified cells are administered to patients (ex vivo). Conventional viral based systems for the delivery include retroviral, lentiviral, poxviral, adenoviral, adeno-associated viral, vesicular stomatitis viral and herpesviral vectors, although integration in the host genome is possible with certain viral vectors, including the retrovirus, lentivirus, and adeno-associated virus gene transfer methods, often resulting in long term expression of the inserted transgene. Additionally, high transduction efficiencies have been observed in many different cell types and target tissues.

pLASN and MFG-S are examples of retroviral vectors that have been used in clinical trials. In applications for which transient expression is preferred, adenoviral-based systems are useful. Adenoviral based vectors are capable of very high transduction efficiency in many cell types and are capable of infecting, and hence delivering nucleic acid to, both dividing and non-dividing cells. With such vectors, high titers and levels of expression have been obtained. Adenovirus vectors can be produced in large quantities in a relatively simple system.

Gene therapy vectors can be delivered in vivo by administration to an individual patient, typically by systemic administration (e.g., intravenous, intraperitoneal, intramuscular, subdermal, or intracranial infusion) or topical application. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have been reprogrammed.

Ex vivo cell transfection for diagnostics, research, or for gene therapy (e.g., via re-infusion of the transfected cells into the host organism) is well known to those of skill in the art. In a preferred embodiment, cells are isolated from the subject organism, transfected with a nucleic acid (gene or cDNA), and re-infused back into the subject organism (e.g., patient). Various cell types suitable for ex vivo transfection are well known to those of skill in the art.

Vectors (e.g., retroviruses, adenoviruses, liposomes, etc.) containing therapeutic nucleic acids can be also administered directly to the organism for transfection of cells in vivo. Alternatively, naked DNA can be administered. Administration is by any of the routes normally used for Introducing a molecule into ultimate contact with blood or tissue cells. Suitable methods of administering such nucleic acids are available and well known to those of skill in the art, and, although more than one route can be used to administer a particular composition, a particular route can often provide a more immediate and more effective reaction than another route.

Pharmaceutically acceptable carriers are determined in part by the particular composition being administered, as well as by the particular method used to administer the composition. Accordingly, there is a wide variety of suitable formulations of pharmaceutical compositions of the present invention.

Delivery of Polypeptides

In most, if not all the methods described herein, an alternative possibility consists of bypassing the use of a polynucleotide and contacting a cell of a first type cell directly with a compound (e.g. a polypeptide) for which an increased intracellular level is desired. In other embodiments, for example in certain in vitro situations, the cells are cultured in a medium containing one or more functional polypeptides.

An important factor in the administration of polypeptides is ensuring that the polypeptide has the ability to traverse the plasma membrane of a cell, or the membrane of an intracellular compartment such as the nucleus. Cellular membranes are composed of lipid-protein bilayers that are freely permeable to small, nonionic lipophilic compounds and are inherently Impermeable to polar compounds, macromolecules, and therapeutic or diagnostic agents. However, proteins, lipids and other compounds, which have the ability to translocate polypeptides across a cell membrane, have been described. For example, "membrane translocation polypeptides" have amphiphilic or hydrophobic amino acid subsequences that have the ability to act as membrane-translocating carriers. Polypeptides for which an increased intracellular level Is desired according to the invention can be linked to suitable peptide sequences for facilitating their uptake into cells. Other suitable chemical moieties that provide enhanced cellular uptake can also be linked, either covalently or non-covalently, to the polypeptides. Other suitable carriers having the ability to transport polypeptides across cell membranes may also be used.

A desired polypeptide can also be introduced into an animal cell, preferably a mammalian cell, via liposomes and liposome derivatives such as immunoliposomes. The term "liposome" refers to vesicles comprised of one or more concentrically ordered lipid bilayers, which encapsulate an aqueous phase. The aqueous phase typically contains the compound to be delivered to the cell. In certain embodiments, it may be desirable to target a liposome using targeting moieties that are specific to a particular cell type, tissue, and the like. Targeting of liposomes using a variety of targeting moieties (e.g., ligands, receptors, and monoclonal antibodies) has been previously described.

Cells and Cell Lines

The invention encompasses the cells, cell lines, stem cells and purified cell preparations derived from any of the methods described herein. In some embodiments, the cells, cells lines, stem cells and purified cells preparations of the invention are of mammalian origins, including but not limited to human, primates, rodent, dog, cat, horse, cow, or sheep. In preferred embodiments, they originate from a human.

Accordingly, another aspect of the invention relates to modified cells, cell lines, pluripotent, multipotent or unipotent cells and purified cell preparations, wherein any of these cells comprise an exogenous polynucleotide encoding Musashi1 (Msi1); Msi1 and Ngn2; Msi1 and MBD2; and Ngn2 and MBD2; Msi1, Ngn2 and MBD2; Msi1, Ngn2, Nestin and MBD2; and other potential combinations from Table A preferably including Msi1 and Ngn2 and MBD2. In preferred embodiments the cell according to the invention is a stem-like cell, more preferably a Neural Stem-Like Cell (NSLC), the cell possessing one or more of the following characteristics:
expression of one or more neural stem cell marker selected from the group consisting of Sox2, Nestin, GFAP, Msi1, and Ngn2;
decreased expression of one or more genes specific to the cell that the NSLC was obtained from (e.g. see Table C);
forms neurospheres in the neurosphere colony formation assay;
capable of being cultured in suspension or as an adherent culture;
capable of proliferating without the presence of an exogenous reprogramming agent for over 1 month, preferably over 2 months, over 3 months, over 5 months and even for more than a year,
capable of dividing every 36 hours at low passage;
positive for telomerase activity;
capable of differentiation into a neuronal-like cell, astrocyte-like cell, oligodendrocyte-like cell and combinations thereof;
decreased expression of telomerase and one or more neural stem cell markers after differentiation;
having one or more morphological neurite-like processes (axons and/or dendrites) greater than one cell diameter in length after differentiation into a neuronal-like cell;
expression of at least one neural-specific antigen selected from the group consisting of neural-specific tubulin, microtubule associated protein 2, NCAM, and marker for a neurotransmitter after differentiation into a neuronal-like cell;
expression of one or more functional neural markers (e.g. synapsin) after differentiation into a neuronal-like cell;
capable of releasing one or more neurotrophic factors (e.g. BDNF) after differentiation into a neuronal-like cell;
negative in a tumor colony forming assay;
negative for tumor growth in SCID mice;
negative for teratoma growth in SCID mice;
capable of significantly improving one or more functional measures after placement of an adequate number of NSLCs into the void in a brain ablation model;
capable of significantly improving or maintaining one or more functional measures after injecting an adequate number of NSLCs into an EAE model; and
capable of improving one or more functional measures more significantly than hNPCs in CNS injury or neurodegenerative models.

Examples of all of the above items can be found in the Examples section of this application.

In preferred embodiments, a NSLC according to the inventions possesses all of the following characteristics:
ability to self-renew for significantly longer than a somatic cell;
is not a cancerous cell;
is stable and not artificially maintained by forced gene expression or by similar means and may be maintained in standard neural stem cell media;
can differentiate to a progenitor, precursor, somatic cell or to another more differentiated cell type of the same lineage;
has the characteristics of a stem cell and not just certain markers or gene expression or morphological appearance; and
does not exhibit uncontrolled growth, teratoma formation, and tumor formation in vivo.

In one particular embodiment, the reprogrammed cells (NSLCs) according to the invention are capable of proliferating for several months without losing their neural stem cell markers and their ability to differentiate towards neuron-like, astrocyte-like, and oligodendrocyte-like cells. The generation of the neural lineages is characterized based on morphology, phenotypic changes and functionality.

In preferred embodiments the cell according to the invention is a stem-like cell, the stem-like cell possessing one or more of the following characteristics:
expression of one or more stem cell marker selected from Table A;

decreased expression of one or more genes specific to the cell that the stem-like cell was obtained from;

capable of being cultured in suspension (as spheres) or as an adherent culture;

capable of proliferating without the presence of an exogenous reprogramming agent for over 1 month, preferably over 2 months, over 3 months, over 5 months or for more than a year;

positive for telomerase activity;

capable of differentiation into cells according to the lineage of that stem-like cell;

decreased expression of telomerase and one or more stem cell markers after differentiation;

having one or more morphological features of the stem cells that the stem-like cell is like;

expression of one or more antigen expressed specifically in the stem cells that the one or more is like;

expression of one or more functional markers of lineage specific differentiated cells after differentiation of the stem-like cell;

negative in a tumor colony forming assay;

negative for tumor growth in SCID mice;

negative for teratoma growth in SCID mice;

capable of significantly improving one or more functional measures after placement of an adequate number of stem-like cells in a model assessing the regenerative potential of those types of stem cells.

In some embodiments, the cells of the invention may have one or more of the following characteristics and properties: self-renewal, multilineage differentiation in vitro and in vivo, clonogenicity, a normal karyotype, extensive proliferation in vitro under well defined culture conditions, and the ability to be frozen and thawed, as well as any of the commonly known and/or desired properties or characteristics typical of stem cells. The cells of the invention may further express molecular markers of multipotent or pluripotent cells (i.e. gene and surface markers as defined previously).

Another aspect of the invention relates to the production of tissue specific autologous (self) stem and/or progenitor cells. These stem and/or progenitor cells may be used in cell therapy applications to treat diseases of cellular degeneration. Diseases of cellular degeneration include, for example, neurodegenerative diseases such as stroke, Alzheimer's disease, Parkinson's disease, multiple sclerosis, Amyotrophic lateral sclerosis, macular degeneration, osteolytic diseases such as osteoporosis, osteoarthritis, bone fractures, bone breaks, diabetes, liver injury, degenerative diseases, myocardial Infarct, burns and cancer. These stem and/or progenitor cells may also be used in cell therapy applications to treat injury such as spinal cord injury, traumatic brain injury, burns, and muscle injury as well as other diseases or other aspects of a disease such as cancer, hepatitis, HIV/AIDS, leukemia and other blood disorders. It is envisioned that cells according to the invention may be implanted or transplanted into a host. An advantage of the invention is that large numbers of autologous stem cells can, be produced for implantation without the risk of immune system mediated rejection. Those cells can lead to production of tissue suitable for transplant into the individual. Since the tissue is derived from the transplant recipient, it should not stimulate an immune response, as would tissue from an unrelated donor. Such transplants can constitute tissues (e.g. vein, artery, skin, muscle), solid organ transplants (e.g., heart, liver, kidney), neuronal cell transplants, or bone marrow transplants such as are used in the treatment of various malignancies such as, for example, leukemias and lymphomas. Neural stem cell, neuroprogenitor, or neuronal cell (as well as NSLCs and derivations thereof) transplants can also be used in the treatment of, for example, neurological disorders, stroke, spinal cord injury, Parkinson's disease, and the like, as well as potentially some non-neurological disorders such as a cardiac infarct.

Another aspect of the invention relates to a method of genetically engineering a cell created according to the present invention, and using said cell for treating a disease or enhancing and/or modulating and/or changing the functionality or characteristics of a cell, tissue, organ or system in a patient. An example includes genetically correcting the dystrophin or $LAMA_2$ gene in a cell obtained from a patient suffering from muscular dystrophy and creating muscle stem-like cells according to the methods of the present invention that are then administered to the patient according to appropriate methods in the art; these muscle stem-like cells can then help to regenerate the muscles of the patient as well as potentially gene correcting existing muscle cells through fusion of the stem-like cells with the patient's existing muscle cells whereby the corrected gene in the stem-like cells replaces the defective gene in the muscle cell. The same process above can be used for treating other genetic diseases whereby the appropriate type of stem-like cell is created according to methods of the present invention to regenerate and/or correct cells, tissues and/or organs in the patient affected by the disease. The same method can also be used for enhancing and/or modulating and/or changing the functionality or characteristics of a cell, tissue, organ or system in a patient. For example, a patient suffering from HIV/AIDS could be treated by obtaining an appropriate cell that has not been infected by HIV, knocking out the CCR5 gene of the cell so that the CCR5 receptor cannot be expressed (if, for example, the cell was a hematopoietic stem cell or any differentiated cell of this lineage), reprogramming this cell into a hematopoietic stem-like cells, and then administering an appropriate number of these hematopoietic stem-like cells into the patient (according to methods known in the art) to allow for proper grafting of these cells into the patient's bone marrow. Since the HIV cannot enter into the $CCR5^-$ (negative) hematopoietic stem-like cells and their progeny (differentiated lineage cells), these cells will over time allow the patient's blood system to function normally and potentially the HIV may even be eradicated. It should be noted that the genetic engineering/modification can take place before, during or after the creation of the stem-like cell of interest for all the above methods and processes in this paragraph. It should also be noted that an allogeneic cell could also be used for all the above methods and processes in this paragraph.

Hematopoietic stem-like cells of the present invention can also be used to repopulate the blood system in patients after certain types of radiotherapy (ex. for cancer). Other appropriate stem-like cells (or cells differentiated from these stem-like cells) can be used to repopulate tissues, organs or a system in a patient after certain types of therapy, surgical intervention or injury has left the patient devoid of enough of certain types of cells that can be provided by the cells, methods and/or uses of the present invention.

Another aspect of the invention relates to a method to produce ex vivo engineered tissues for subsequent implantation or transplantation into a host, wherein the cellular components of those engineered tissues comprise cells according to the invention, or cells derived therefrom. For example, expanded cultures of the cells of the invention may be differentiated by in vitro treatment with growth factors and/or morphogens. Populations of differentiated cells are then implanted into the recipient host near the site of injury or damage, or cultured in vitro to generate engineered tissues, as described.

The methods and cells of the invention described herein can be used to immortalize (or near-immortalize) cells, for example to generate a cell line. Using the methods disclosed herein, a somatic cell can be transformed into one possessing a dedifferentiated phenotype, thereby facilitating the generation of cell lines from a variety of tissues. Therefore, the invention encompasses such immortalized (or near-immortalize) cells.

In addition, the methods of deriving the cells according to the invention, may be helpful in scientific and therapeutic applications including, but not limited to, (a) scientific discovery and research Involving cellular development and genetic research (e.g. uses in lieu of human stem cells as a model cell line to study the differentiation, dedifferentiation, or reprogramming of human cells), (b) drug development and discovery (e.g., screening for efficacy and toxicity of certain drug candidates and chemicals, screening for prospective drugs or agents which mediate the differentiation, dedifferentiation, or reprogramming of cells), (c) gene therapy (e.g., as a delivery device for gene therapy), and (d) treatment of injuries, trauma, diseases and disorders including, but not limited to, Parkinson's, Alzheimer's, Hunting-ton's, Tay-Sachs, Gauchers, spinal cord injury, stroke, burns and other skin damage, heart disease, diabetes, Lupus, osteoarthritis, liver diseases, hormone disorders, kidney disease, leukemia, lymphoma, infectious diseases, HIV/AIDS, multiple sclerosis, rheumatoid arthritis, Duchenne's Muscular Dystrophy, Ontogenesis imperfecto, birth defects, infertility, pregnancy loss, and other cancers, degenerative and other diseases and disorders.

Additional aspects concern therapeutic methods, methods of treatment and methods of regenerating a tissue or organ in a mammal (e.g. a human subject). One particular method concerns a method of regenerating a mammalian tissue or organ which comprises contacting the tissue or organ to be regenerated with a SLC, NSLC, or other desired cell or artificial tissue construct as defined herein. The SLC, NSLC, desired cell or artificial tissue construct may be placed in proximity to the tissue or organ to be regenerated by administering to the subject using any suitable route (e.g. Injecting the cell Intrathecally, directly into the tissue or organ, or into the blood stream).

Another method for repairing or regenerating a tissue or organ in a subject in need thereof comprises administering to the subject a compound inducing a direct or indirect endogenous expression of at least one gene regulator in cells of the tissue or organ and/or a compound Inducing a direct or indirect endogenous expression of at least one gene regulator in cells capable of transformation or dedifferentiation in vivo in the subject. Accordingly, the expression of the at least one gene regulator reprograms the cells into desired cells of a different type (e.g. neural stem-lice cells), and these cells of a different type are effective in repairing or regenerating said tissue or organ.

Another method comprises obtaining cells or tissue from a patient (e.g. hematopoietic stem cells, fibroblasts, or keratinocytes), reprogramming a plurality of such cells or the tissue, and reintroducing the reprogrammed cells or tissue into the patient. A related aspect concerns pharmaceutical compositions comprising a plurality of a desired cell, SLC and/or Neural Stem-Like Cell (NSLC) or reprogrammed tissue as defined herein.

The therapeutic methods of the invention may be applicable to the regeneration or repair of various tissues and organs including, but not limited to, the brain, the spinal cord, the heart, the eye, the retina, the cochlea, the skin, muscles, intestines, pancreas (including beta cells), kidney, liver, lungs, bone, bone marrow, blood system, cartilage, cartilage discs, hair follicles, teeth, blood vessels, glands (including endocrine and exocrine glands), ovaries, reproductive organs, mammary and breast tissue.

A related aspect concerns pharmaceutical compositions comprising a plurality of desired cell, SLC and/or Neural Stem-Like Cell (NSLC) as defined herein.

Tissues

Another aspect of the invention relates to a tissue containing reprogrammed cells as defined herein that can be implanted into a subject in need thereof.

In some embodiments the present invention provides for the reprogramming of cells within a tissue, for example an in vitro produced 3D tissue construct comprising cells and extracellular matrix produced by these cells. In addition, transfected cells can be seeded on top of these 3D tissue constructs that can be made completely autologously, thus preventing host rejection, making it completely immunocompatible and as carrier for reprogrammed cells to be transplanted in vivo. Advantageously, these newly created cells can be used in their undifferentiated and/or differentiated state within these tissues for in vitro diagnostic purposes or transplanted into a patient in need of such a construct in cell therapy/tissue replacement approaches.

The invention further encompasses 3D Neuronal-Like multilayer tissue. Cells within CDM reprogrammed to Neural Stem-Like Cells according to the invention readily differentiate into neuronal-like cells, astrocyte-like cells, and oligodendrocyte-like cells within the CDM. It is thus possible to use CDM and reprogramming methods of the invention to reprogram the cells within the CDM to form 3D Neuronal-Like multilayer tissue (up to >30 cell layers). Such 3D tissue comprises neurons (or specifically, neuron-like cells), astrocytes (or specifically, astrocyte-like cells), and oligodendrocytes (or specifically, oligodendrocyte-like cells) and it can be made completely autologously, can be manually handled and implanted with relative ease, or can used as an in vitro CNS tissue model.

One particular aspect concerns an artificial tissue construct which comprises a 3D assembly of in vitro cultured cells and extracellular matrix produced by these cells. The cells may be desired cells, SLC and/or a plurality of Neural Stem-Like Cell (NSLC) obtained using any one of the methods described herein.

Screening Methods

Another aspect of the invention relates to methods for identifying new compounds (e.g. small molecules, drugs, etc) capable of transforming a cell of a first type to a desired cell of a different type, as well as identifying the molecular and cellular pathways for reprogramming. These new compounds may be useful for research purposes or as medicaments for use in repairing or regenerating cells, tissues or organs in a subject while these pathways may be useful for research purposes to develop research tools, diagnostics, and medicaments for use in repairing or regenerating cells, tissues or organs in a subject and for other uses. Those skilled in the art will understand that it is conceivable to screen for compounds that will induce transformation of a cell of a first type to a stem-like cell by replacing the "induction" or "biological activity" provided by the transient increase of the reprogramming agent or gene regulator in the cell by a candidate compound to be tested (e.g. a library of small molecules or compounds) and measuring activity or efficacy of the candidate compound in generating the stem-like cell; individual or a mixture of active compounds would be selected if they have the same activity and/or if they can provide the same or similar effects as these polypeptides or compounds (e.g. cell transformation and/or appearance of any desirable markers or desirable characteristics as defined hereinbefore). Another aspect of the invention relates to methods for identifying the molecular and cellular pathways for reprogramming.

The Examples section provides principles, methods and techniques useful for screening and identifying such desirable active compounds. For instance, those skilled in the art will understand that it is conceivable to screen for compounds that will Induce transformation of a cell of a first type to a NSLC by replacing the "induction" or "biological activity" provided by the transient increase of Musashi1, NGN2 or MBD2 in the cell by a candidate compound to be tested (e.g. a library of small molecules or compounds) and measuring activity or efficacy of the candidate compound in generating the NSLC. Individual or mixture of active compounds would be selected if they have the same activity and/or if they can provide the same or similar effects as these polypeptides (e.g. cell transformation and/or appearance of any desirable markers or desirable characteristics as defined hereinbefore). For example, a compound or mixture of compounds capable of transforming a fibroblast into a NSLC could be identified by:

(i) Setting up, culturing and transforming the fibroblasts into NSLC as in Example 1;
(ii) Screening a library of compounds by replacing Msi1, Ngn2 and/or MBD2 with each candidate compound in a different well;
(iii) Identify a compound 'hit' when the candidate compound is able to transform the fibroblasts into NSLCs approximately as well as the replaced Msi1, Ngn2 and/or MBD2;
(iv) If compound from part (iii) did not replace all of Msi1, Ngn2 and MBD2, and is not able to transform the fibroblasts into NSLCs by itself, then by including the compound from (iii) in each well, screening a library of compounds by replacing the Msi1, Ngn2 and/or MBD2 that was not removed in part (ii) with each candidate compound in a different well;
(v) Identify a compound 'hit' when the candidate compound is able to transform, along with the compound from part (iii), the fibroblasts into NSLCs approximately as well as the replaced Msi1, Ngn2 and/or MBD2;
(vi) If compound from part (V) did not replace all of Msi1, Ngn2 and/or MBD2, and is not able to transform the fibroblasts into NSLCs together with the compound from part (iii), then by including the compound from (iii) and (v) in each well, screening a library of compounds by replacing the Msi1, Ngn2 or MBD2 that was not removed in part (ii) and (iv) with each candidate compound in a different well;
(vii) Identify a compound 'hit' when the candidate compound is able to transform, along with the compound from part (iii) and (v), the fibroblasts into NSLCs approximately as well as the replaced Msi1, Ngn2 or MBD2;
(viii) A combination of the compounds from part (iii), (v) and (vii) will be able to transform the fibroblasts into NSLC; modifications to these compounds can be made and further screened to identify more effective or safe versions of these compounds.

The same principles are applicable for other desired types of stem-like cells including pluripotent-like cells, mesendoderm-like cells, pancreatic progenitor-like cells, etc. Tables A and B, and the Examples section provides, for each of these types of cells, a list of potential genes and/or compounds to be considered in such screening methods.

Accordingly, the present invention encompasses these and any equivalent screening methods where candidate compounds are tested for their efficacy in transforming a cell of a first type to a desired cell of a different type when compared to the efficacy of the reprogramming agent, reprogramming factor and/or gene regulator as defined herein.

Delivery of Neurotrophic Factors

A related aspect of the invention relates to local delivery of trophic factors (ex. growth factors) to a tissue or organ of interest by transplanting stem-like cells and cell lines according to the invention which can stably express and secrete growth factors of potential interest after transplantation to said tissue or organ.

Local delivery of neurotrophic factors has been suggested as a method to treat several neurological conditions. Strategies using neurotrophic molecules focus on preventing the progressive loss of neurons, maintaining neuronal connections and function (neuroprotection), and inducing additional regenerative responses in neurons such as increased neurotransmitter turnover and/or axonal sprouting (neuroregeneration). Up to date, several therapeutic strategies to deliver neurotrophic-factors in animal models have been explored, but so far testing of the effects of growth factors on the brain and nervous system have been limited to direct peripheral injection of large doses of these factors, which carries a significant risk of side effects. Accordingly, a related aspect of the invention relates to overcoming these problems by using NSLC cells and cell lines according to the invention which can stably express and secrete growth factors of potential Interest after transplantation.

To summarize, the present invention provides a plentiful source of Stem-Like Cells and their progeny (differentiated cells) for potential clinical treatments which require transplantation of specific stem cells to 1) compensate for a loss of host cells or 2) as vehicles to deliver genetically-based drugs. For example, Neural Stem-Like Cells, Neuron-Like Cells, Astrocyte-Like Cells or Oligodendrocyte-Like Cells can be used for potential clinical treatments which require transplantation of neural stem cells, neurons, astrocytes or oligodendrocytes 1) to compensate for a loss of CNS host cells (ex. neurons) or 2) as vehicles to deliver genetically-based drugs (ex. BDNF). Further, the invention provides a novel neurological tool for use in basic research and drug screening.

Those skilled in the art will recognize, or be able to ascertain using no more than routine experimentation, numerous equivalents to the specific procedures, embodiments, claims, and examples described herein. Such equivalents are considered to be within the scope of this invention and covered by the claims appended hereto. The invention is further illustrated by the following examples, which should not be construed as further limiting.

EXAMPLES

The examples set forth herein below provide exemplary methods for obtaining Reprogrammed and Dedifferentiated cells, including Neural Stem-Like Cells (NSLCs). Also provided are exemplary protocols, molecular tools, probes, primers and techniques.

Example I

Preparation of Human Fibroblast Cells

Human Foreskin fibroblast (HFF) cells were purchased from American Type Culture Collection (ATCC, Manassas, Va) and expanded in cell culture flasks with Dulbecco's Modified Eagle's Medium (DMEM, Invitrogen), supplemented with 10% heat-inactivated fetal calf serum (FCS, Hyclone Laboratories), 0.1 mM non-essential amino acids, and 1.0 mM sodium pyruvate (Invitrogen) at 37° C., 5% $CO_2$. The medium was changed twice per week. Cells were trypsinized using Trypsin 0.25% for 4 minutes at 37° C., followed by adding trypsin inhibitor solution, pelleting the cells by centrifugation, washing the cells once with PBS, and plating the cells at a ratio of 1:2 onto tissue culture flasks until a suitable number of cells was reached.

Cells were then trypsinized and plated ($8 \times 10^4$ cells/well) in cell culture plates pre-coated with Laminin (10 μg/ml, Sigma) in two different composition of CDM medium: CDM I Medium consisting of a 3:1 ratio of Dulbecco's modified Eagle medium (DMEM, high glucose (4.5 g/L) with L-glutamine and sodium pyruvate) and Ham's F-12 medium supplemented with the following components: EGF ($4.2 \times 10^{-10}$M), bFGF ($2.8 \times 10^{-10}$M), ITS ($8.6 \times 10^{-5}$M), dexamethasone ($1.0 \times 10^{-7}$M), L-3,3',5-triiodothyronine ($2.0 \times 10^{-10}$M), ethanolamine ($10^{-4}$M), GlutaMAX™ ($4 \times 10^{-3}$M), and glutathione ($3.3 \times 10^{-6}$M), but without the presence of L-ascorbic acid.

CDM II Medium consisting of a 3:1 ratio of Dulbecco's modified Eagle medium (DMEM, high glucose (4.5 g/L) with L-glutamine and sodium pyruvate) and Ham's F-12 medium supplemented with the following components: EGF (2.5 ng/ml), bFGF (10 ng/ml), ethanolamine (2.03 mg/ml), insulin (10 mg/ml), Selenious acid (2.5 μg/ml), dexamethasone (19.7 μg/ml), L-3,3',5-triiodothyronine (675 ng/ml), GlutaMAX™ ($4 \times 10^{-3}$M), and glutathione ($3.3 \times 10^{-6}$M).

Transient Transfection of HFF by Lipofectamine Using Constructed Vectors

After two days in culture, cells were transfected with pCMV6-XL5-MBD2 (2 μg) (a DNA demethylator) using lipofectamine reagent (Invitrogen) as per the manufacturer's protocol. The DNA-lipid complex was added to cells and incubated for 24 h at 37° C., 5% $CO_2$. After 24 hours of transfection with the DNA demethylator, the medium was changed and cells were transfected by pCMV6-XL5-Musashi1 (2 μg, Origene) or pCMV6-XL4-Ngn2 (2 μg, Origene) for 24 h. After 24 hours, the medium was changed to Neural Progenitor Basal Medium (NPBM, Lonza) supplemented with Noggin (20 ng/ml, Peprotech), EGF (20 ng/ml, Peprotech), and bFGF (20 ng/ml, Peprotech) and cultured in this Proliferation Medium. Cells were retransfected after three days and incubated at 37° C., 5% $CO_2$ and 5% $O_2$. After 7 days in proliferation conditions, 50% of the Proliferation Medium was changed to Differentiation Medium (NbActive, BrainBits™) supplemented with Forskolin (10 μM, Tocris), al-trans-Retinoic Acid (ATRA, 5 μM, Spectrum), bFGF (20 ng/ml, Peprotech), NGF (20 ng/ml, Peprotech), and BDNF (20 ng/ml, Peprotech); medium was changed every day by increasing the percentage of Differentiation Medium over Proliferation Medium, and the cells were cultured for 20 days.

Visual observation of reprogrammed cells was performed by light microscopic observation every day following transfection using bright field at 10× magnification. Samples were collected at different time points (6, 12, and 20 days) to analyze neuronal gene expression and protein levels by gene array and immunohistochemistry. Following transfection, reprogramming cells displayed a rapid change in cellular morphology within 3 days post-transfection. The cells were more rounded and the cell's cytoplasm retracted towards the nucleus forming contracted cell bodies with extended cytoplasmic extensions and exhibiting neuronal perikaryal appearance at day 6 and 12, which was maintained until day 20. However, this morphology was not observed in untransfected cells at day 6 and 12.

Gene Array Analysis

Characterization of the newly engineering cells after transfection was performed using a neuronal gene-array containing 48 partial cDNAs coding for these genes and controls.

RNA was isolated from samples using QIAshredder™ (Qiagen) and RNeasy™ Plus mini Kit (Qiagen) as per manufacturer's instructions. DNase I treatment was performed on the RNeasy™ Column to further remove the transfected plasmid DNA using Rnase-Free DNase Set (Qiagen). RNA was eluted in 35 μl of RNase-free water. Before cDNA synthesis, all RNA samples were quantified using the NanoDrop 1000™ (ThermoScientific). cDNA was prepared using the High Capacity cDNA archive kit (Applied Biosystems) as per the manufacturer's instructions. 400 ng of RNA was used in each 50 μl RT reaction. The resulting cDNA samples were used immediately for TLDA analysis. For each card of the Taqman™ low-density array (TLDA), there are eight separate loading ports that feed into 48 separate wells for a total of 384 wells per card. Each 2 μl well contains specific, user-defined primers and probes, capable of detecting a single gene. In this study, a customized Neuronal Markers 2 TLDA was configured into eight identical 48-gene sets, i.e. 1 loading port for each 48-gene set Genes were chosen based on literature. Each set of 48 genes also contains three housekeeping genes: ACTIN, GAPDH, and PPIA.

A sample-specific master mix was made for each sample by mixing cDNA (160 ng for each loading port), 2× Taqman™ Gene Expression Master Mix (Applied Biosystems) and nuclease-free water (USB) for a total of 100 μl per loading port. After gentle mixing and centrifugation, the mixture was then transferred into a loading port on a TLDA card. The array was centrifuged twice for 1 minute each at 1200 rpm to distribute the samples from the loading port into each well. The card was then sealed and PCR amplification was performed using Applied Biosystems 7900HT™ Fast Real-time PCR system. Thermal cycler conditions were as follows: 2 minutes at 50° C., 10 minutes at 94.5° C., and 30 seconds at 97° C., 1 minute at 59.7° C. for 40 cycles. 1 TLDA's was prepared for 8 samples.

Relative Expression values were calculated using the Comparative $C_T$ method. Briefly, this technique uses the formula $2^{-\Delta \Delta C_T}$ to calculate the expression of target genes normalized to a calibrator. The threshold cycle ($C_T$) indicates the cycle number at which the amount of amplified target reaches a fixed threshold. $C_T$ values range from 0 to 40 (the latter representing the default upper limit PCR cycle number that defines failure to detect a signal). $\Delta C_T$ values [$\Delta C_T = C_T$ (target gene)$-C_T$ (Average of 3 Housekeeping genes)] were calculated for HFF Ctrl, and subsequently used as the calibrator for the respective samples. All gene expression values were assigned a relative value of 1.00 for the calibrator, which is used to determine comparative gene expression such that $\Delta \Delta C_T = \Delta C_T$ (Treated)$-\Delta C_T$ (HFF Ctrl). Relative Expression is calculated using the formula $2^{-\Delta \Delta C_T}$.

Quantitative comparison of astrocyte, neuron, and oligodendrocyte gene expression allowed identification of the majority of the genes that are differentially expressed in reprogrammed cells. Data in Table 1 were analyzed by using a significance analysis algorithm to identify genes that were reproducibly found to be enriched in reprogrammed cells compared to untransfected cells. After the transfection with Msi1 or Ngn2 in the presence of MBD2, the expression of oligodendrocytes progenitors such as NKx2.2, olig2, and MAG and two markers for astrocytes (GFAP and AQP4) were highly increased. Also, several markers of early neuronal cells were enhanced after the transfection of HFF. TDLA data revealed a remarkable increase in specific markers for interneurons, such as somatostatin and calbindin1. The induction of Doublecortin (DCX), which is expressed by migrating immature cells during development, and acetylcholine (ACHE) mRNA, an early marker of neuronal cells, were highly expressed in the reprogrammed cells (Table 1). Transfection increased the expression of dihydropyrimidinase-like 3 (DPYSL3), an early marker of newborn neurons, to fivefold with Msi1 and seven fold with Ngn2. Expression of Microtubule-Associated Protein 2 (MAP2), an essential marker for development and maintenance of early neuronal morphology and neuronal cell adhesion molecule, were highly expressed with Msi1 and Ngn2 (Table 1). The expression of enolase-2, a marker of mature neurons, was 20-fold enhanced by Msi1 and Ngn2. Member of the NeuroD family NeuroD1 was highly expressed after transfection with Msi1 to 84 fold and to 34 by Ngn2.

Gene expression of growth factors such as IGF-1, IGF2, NPY and CSF-3 was also enhanced in reprogrammed cells. The expression of VEGF and GDNF genes were up-regulated to almost five fold and seven fold by Msi1 and Ngn2, respectively. However, the expression of BDNF. EGF, and bFGF were not activated and even down-regulated as compared to untransfected cells. The expression of growth associated protein (GAP-43), a growth- and regeneration-associated marker of neurons, and expression of netrin, implicated in neuronal development and guidance, were highly enriched in reprogrammed cells. Expression of receptors for growth and neurotrophin factors was increased, such as type III receptor tyrosine kinase, neurotrophic tyrosine kinase, and neurotrophic tyrosine kinase receptor. Vimentin and fibronectin, markers for fibroblasts, were down-regulated in reprogrammed cells compared to the untransfected control fibroblast cultures.

TABLE 1

Gene array of transfected human fibroblast cells by Msi1/MBD2 and Ngn2/MBD2.
Gene array was performed on samples after two weeks of differentiation.
Expression values are given relative to untransfected fibroblasts

| Symbol | Common name and description | Company Gene ID | Relative expression to Msi1 | Relative expression to Ngn2 |
|---|---|---|---|---|
| Astrocytes and oligodendrocytes markers | | | | |
| NKx2-2 | Markers for oligodendrocyte progenitors | NM_002509.2 | very high | very high |
| OLIG2 | Oligodendrocyte lineage transcription factor 2 | NM_005806.2 | 47.511 | 8.38 |
| MAG | Myelin-associated glycoprotein | NM-080600.1 | 212.61 | 4.51 |
| GFAP | Glial fibrillary acidic protein | NM_002055.4 | very high | very high |
| AQP4 | Aquaporin 4 | NM_001650.4 | 83.77 | 56.86 |
| NC markers | | | | |
| SST | Somatostatin, specific marker for interneurons | NM_001048.3 | 32.73 | 35.34 |
| CALB1 | Calbindin 1, interneuron marker | NM_004929.2 | 18.21 | 13.22 |
| Tubulin1A | Are necessary for axonal growth | NM_006009.2 | 7.45 | 9.32 |
| NES | Precursor neurons (nestin) | NM_006617.1 | 1.61 | 1.54 |
| DCX | An early neuronal marker (Doublecortin) | NM_178151.1 | very high | very high |
| ACHE | Acetylcholinesterase, marker of early neuronal development | NM_015831.2 | 9.02 | 13.22 |
| ENO2 | A marker for neurons cells, enolase | NM_001975.2 | 22.62 | 20.68 |
| NEUROD1 | Neural marker; expression gradually increased from neural precursor to fully differentiated neuron | NM_002500.2 | 84.22 | 34.27 |
| DPYSL3 | Dihydropyrimidinase-like3, marker of immature neurons | NM_001387.2 | 5.33 | 7.02 |
| MAP2 | Microtubule-associated protein 2, essential for development of early neuronal morphology and maintenance of adult neuronal morphology | NM_002374.3 | 86.38 | 89.67 |
| NCAM | Neural cell adhesion molecule 1 | NM_18135.3 | very high | very high |
| CEND1 | Cell cycle exit & neuronal differentiation, early marker of proliferating precursor cells that will differentiate to neurons | NM_016564.3 | 4.80 | 5.57 |
| Neuroregeneration and survival genes | | | | |
| FGF2 | Fibroblast growth factor | NM_002006.4 | 0.06 | 0.11 |
| EGF | Epidermal growth factor, | Hs00153181_m1 | 0.99 | 0.56 |
| IGF-1 | Insulin growth factor-1, | NM_000618.2 | 58.92 | 21.21 |
| IGF-2 | Insulin growth factor-2 | NM_0000612.3 | very high | very high |
| CSF3 | Granulocyte colony-stimulating factor | NM_2219.1 | very high | 42.60 |
| BDNF | Brain derived growth factor, neurogenesis | NM-199231.1 | 0.05 | 0.03 |
| GDNF | Glial derived neurotrophic factor | NM-000614.2 | 4.77 | 6.89 |
| CNTF | Ciliary neurotrophic factor | NM_001025366.1 | 1.86 | 1.09 |
| VEGF | Vascular endothelial growth factor | | 6.67 | 7.32 |
| BMP-4 | Bone morphogenetic protein 4 | NM_130850.1 | 5.96 | 8.57 |

TABLE 1-continued

Gene array of transfected human fibroblast cells by Msi1/MBD2 and Ngn2/MBD2.
Gene array was performed on samples after two weeks of differentiation.
Expression values are given relative to untransfected fibroblasts

| Symbol | Common name and description | Company Gene ID | Relative expression to Msi1 | Relative expression to Ngn2 |
|---|---|---|---|---|
| KDR | Type III receptor tyrosine kinase) | NM_002253.1 | 31.78 | 6.83 |
| NTRK2 | Neurotrophic tyrosine kinase receptor (TrkB) | NM_006180.3 | 10.31 | 13.37 |
| NPY | Neuropeptide factors | NM_00905.2 | very high | very high |
| PIK3CG | phosphoinositide-3-kinase, | NM_002649.2 | very high | very high |
| STAT3 | Signal transduction transcription 3 | NM_213662.1 | 2.14 | 3.65 |
| Gap43 | Growth associated protein 43 | NM_002045.2 | very high | very high |
| NTN1 | Netrin1, implicated in neuronal development and guidance | _NM_006180.3 | 26.84 | 23.98 |
| NTRk2 | Neurotrophic tyrosine kinase, receptor, type 2 | NM_024003.1 | 10.31 | 13.37 |
| Slit | Axonal guidance molecules | NM_003061.1 | very high | very high |
| Vimentin | Radial glia and fibroblast marker | Hs00185584 | 0.11 | 0.13 |
| Fibronectin | fibronectin is a marker for fibroblasts | NM_212474.1 | 0.15 | 0.23 |

Immunohistochemical Analysis

Cells were fixed with a 4% formaldehyde/PBS solution for 10 min at room temperature and subsequently permeabilized for 5 min with 0.1% Triton X-100™ in 4% formaldehyde/PBS. After two brief washes with PBS, unspecific antibody binding was blocked by a 30 min incubation with 5% normal goat serum in PBS. Then primary antibodies were added in 5% normal goat serum/PBS as follows: Mouse anti-Nestin (1:100, BD) as an intermediate microfilament present in neural stem cells and mouse anti-NCAM (1:100, Neuromics) as neuronal adhesion molecule. After a 2 h incubation the cells were washed 4 times for 5 min each with 0.1% Tween™/PBS. Appropriate fluorescence-tagged secondary antibody was used for visualization; Goat anti-mouse 546 (1:200, invitrogen) prepared in 5% normal goat serum/PBS was used. After incubation for one hour, cells were washed in 0.1% Tween™/PBS three times for 5 min each. The DNA stain Hoechst33342 (Invitrogen) was used as a marker of nuclei (dilution 1:5000 in PBS, 10 min incubation). Fluorescence images were taken with a Cellomics™ ArrayScan HCS Reader microscopy system. To determine an estimate of the percentage of cells adopting neuronal or glial phenotypes, random fields were selected and for each field the total number of cells (as determined by counting Hoecht stained nuclei) and the total number of cells positive for neuronal or glial markers were determined.

To confirm that these cells exhibited markers of neuronal lineages, cells were immunostained for nestin and NCAM. This analysis revealed that reprogrammed cells expressed both proteins. NCAM was present in cells during the 6 days post-transfection and increase at day 12 and 20 following differentiation, while the inverse pattern was observed for the nestin staining.

This study showed the ability to reprogram HFF cells using one neurogenic transcription factor with the presence of a DNA demethylator towards cells that expressed neuronal genes and proteins specific to neural stem cells and neuronal cells. These reprogrammed cells were stable in culture for at least 2 weeks.

Example II

Comparison of Reprogramming Efficiency of Three Different Neurogenic Genes

HFF cells were cultured as described in Example I and plated in CDM I medium. Cells were transfected using the Amaxa Nucleofector™ Device (Lonza). The HFFs were harvested with TrypLE™ (Gibco), resuspended in CDM Medium and centrifuged for 10 min at 90×g ($1\times10^6$ cells/tube). The supernatant was discarded and gently resuspended in 100 µl of Basic Nucleofector™ Solution (basic Nucleofector™ kit for primary mammalian fibroblasts, Lonza). Each 100 µl of cell suspension was combined with a different mix of plasmid DNA (for example, sample 1 was mixed with 2 µg of pCMV6-XL5-Pax6 and 2 µg pCMV6-XL5-MBD2). Cell suspension was transferred into an Amaxa certified cuvette and transfected with the appropriate program (U023). The sample was transferred without any further resuspension into a coated culture plate with LAS-Lysine/Alanine (BrainBits™, 50 µg/ml) and the cells were incubated at 37° C., 5% $CO_2$. These steps were repeated for each sample that was transfected. After 24 hours, the medium was changed to Proliferation Medium. After two days, cells were retransfected using lipofectamine as described in Example I and incubated at 37° C., 5% $CO_2$ and 5% $O_2$. After 6 days, differentiation was induced with Differentiation Medium that gradually replaced the Proliferation Medium over several days. Cells were collected at day 14 for RT-PCR and immunohistochemistry analysis.

Gene Expression Analysis

RNA isolation and quantification was performed as previously described in Example I. cDNA was prepared using the High Capacity cDNA RT kit (Applied Biosystems) as per the manufacturer's instructions with a final cDNA concentration of 2 ng/µl. Real-time PCR was then performed for each gene of interest using the FAST PCR master mix (Applied Biosystems) and the Taqman™ Gene Expression Assays (Applied Biosystems) listed below:

| Gene Name | Assay ID |
|---|---|
| ACHE | Hs00241307_m1 |
| NES | Hs00707120_s1 |
| TUBB3 | Hs00964962_g1 |
| GFAP | Hs00157674_m1 |
| PAX6 | Hs00240871_m1 |
| MSI1 | Hs01045894_m1 |
| NGN2 | Hs00702774_s1 |
| MAP2 | Hs00258900_m1 |
| GAPDH (housekeeping gene) | Hs99999905_m1 |
| PPIA (housekeeping gene) | Hs99999904_m1 |

The FAST 96-well reaction was performed with 8 ng cDNA per well in a 10 µl reaction with cycles. Thermal cycler conditions were as follows: 20 seconds at 95° C., and 1 second at 95° C., 20 seconds at 60° C. for 40 cycles.

Relative Expression values were calculated as previously described in Example I, except the Average of 2 Housekeeping genes (GAPDH & PPIA) was used for normalization instead of the Average of 3 Housekeeping genes. Identification of neuronal lineage genes was Investigated following the transfection with three independent vectors containing Msi1, Ngn2, and Pax6.

As shown in Table 2, after 14 days following transfection, relative expression of mRNA of neuronal lineage was undetectable in untransfected cells (HFF), while the cells transfected with Msi1 or Ngn2 in the presence of MBD2 expressed neural stem cell markers (Nestin and Sox2), however the expression of Sox2 was much more highly expressed than nestin following transfection with Ngn2 or Msi1. Neuronal and astrocyte specific genes (βIII-Tubulin, MAP2b, GFAP, and ACHE) was increased as well. mRNAs level of the tripotent-associated genes βIII-tubulin, MAP2b, acetycholine, and GFAP were undetectable in Pax6 transfected cells, indicating that Pax6 alone was not implicated in the reprogramming process toward neuronal lineage.

Example III

Transfection of HFF by Various Combinations of Vectors and Disruption of Cell Cytoskeleton Various combinations of neurogenic regulators and cytokines for epigenetic modifications were tested to ascertain their effect on reprogramming efficiency. Starting one day before transfection, cells were treated with or without cytochalasin B (Calbiochem), with the concentration decreased every day over five days during media changes (starting with 10 µg/ml Cytochalasin B on day 1 to 7.5 µg/ml, 5 µg/ml, 2.5 µg/ml, and 0 µg/ml over the subsequent four days) in order to investigate the effect of disrupting the cell cytoskeleton on the process of reprogramming. Cells were transiently transfected as described in Example II with one or two vectors containing one neurogenic transcription factors by nucleofection. Cells were co-transfected with either of two DNA demethylators, MBD2 or GAdd45B, (e.g. $2 \times 10^6$ cells were transfected with pCMV6-XL5Msi1 (2 µg) and pCMV6-XL5-MBD2 (2 µg)). After 24 hours, the medium was changed to Neural Proliferation Medium (NeuroCult™ proliferation Kit, StemCell Technologies) consisting of DMEM/F12 (1:1), glucose (0.6%), sodium bicarbonate (0.1%), glutamine (20 mM), HEPES (5 mM), Insulin

TABLE 2

Relative expression of gene expression of different neuronal lineage performed by RT-PCR following the transfection of HFF by Msi1, Ngn2, or Pax6 in the presence of MBD2 and cultured for 14 days.

| | MSI1 | | NGN2 | | PAX6 | | NES | | TUBB3 | |
|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. |
| #1 Control Untransfect. | 1.00 | 0.07 | 1.08 | 0.57 | 1.11 | 0.67 | 1.00 | 0.02 | 1.00 | 0.01 |
| #2 MSI1/MBD2 | 4077.82 | 248.02 | 1.18 | 0.66 | 487.09 | 69.58 | 8.62 | 0.00 | 6.58 | 0.11 |
| #3 NGN2/MBD2 | 14.16 | 0.63 | 47803.26 | 192.78 | 624.31 | 91.27 | 8.62 | 0.02 | 8.33 | 0.02 |
| #4 PAX6/MBD2 | 1.70 | 0.36 | 0.27 | 0.01 | 29564.43 | 357.89 | 0.46 | 0.00 | 0.49 | 0.02 |

| | | ACHE | | GFAP | | MAP2 | | SOX2 | |
|---|---|---|---|---|---|---|---|---|---|
| | | Rel. Exp. | Std. Dev. | Rel. Exp. | Std. Dev. | Rel. Exp. | Std. Dev. | Rel. Exp. | Std. Dev. |
| | #1 Control Untransfect. | 1.02 | 0.29 | 1.00 | 0.06 | 1.00 | 0.01 | 1.00 | 0.09 |
| | #2 MSI1/MBD2 | 6.58 | 0.64 | 215.71 | 20.65 | 5.50 | 0.46 | 3499.53 | 184.85 |
| | #3 NGN2/MBD2 | 8.33 | 0.97 | 365.60 | 5.11 | 5.42 | 0.00 | 4039.03 | 8.65 |
| | #4 PAX6/MBD2 | 1.98 | 0.48 | 1.15 | 0.13 | 0.55 | 0.04 | 1.00 | 0.03 |

Immunohistochemical Analysis

Fluorescent immunohistochemical staining was performed as previously described in Example I. In agreement with the RT-PCR data, immunohistochemical analysis of these cultures revealed that reprogrammed cells (with Msi1 or Ngn2) generated morphologically complex neurons that were positive for MAP2b, indicating the differentiation of NSLCs to neuron-like cells (NLCs). However, the positive staining for these markers was undetectable after transfection with Pax6/MBD2. Moreover, the newly formed neurons expressed the markers for and developed long neurites with growth cones at their ends, expressed neural specific genes, and ceased to proliferate when they were exposed to differentiation conditions.

(230 µg/ml), transferrin (100 µg/ml), progesterone (200 nM), putrescine (90 µg/ml), and sodium selenite (300 nM) and supplemented with Noggin (20 ng/ml, Peprotech), recombinant hFGF (20 ng/ml, Peprotech), and recombinant hEGF (20 ng/ml, Peprotech) and cells were cultured for two weeks at 37° C., 5% $CO_2$ and 5% $O_2$. Cells were then analyzed for neural stem cell markers.

Gene Expression Analysis

Gene expression analysis was performed for neural stem-specific markers (Sox2, Nestin, GFAP) and a fibroblast-specific marker (Col5A2) by RT-PCR as previously described in Example I. RT-PCR analysis showed that the relative expression of Sox2, nestin and GFAP was enhanced after transfecting the cells with the neurogenic transcription factors. As shown in Table 3, transfecting the cells with one transcription factor Msi1 in the presence of Gadd45b was associated with up-regulation of relative expression of Sox2 (22.3±5.26) and GFAP (10.14±0.15) and the expression of the these genes was highly increase when transfecting the cells with Ngn2 by 20 fold and 10 fold respectively. Combining the two neurogenic factors (Msi1 and Ngn2) with Gadd45b enhanced further the expression of Sox2 and GFAP. Transfecting the cells with one transcription factor (Msi1 or Ngn2) In the presence of MBD2 was associated with up-regulation of relative expression of Sox2, Nestin, and GFAP and down-regulation of Col5A2, while co-transfection with Gadd45b did not increased the expression of nestin and the expression of Col5A2 was not regulated. The enhancement of neural stem cells relative expression was observed when transfecting the cells with two neurogenic genes in combination with MBD2; a small increase in the expression was noticed in the presence of cytochalasin B under certain conditions. An increase in the relative expression of the neural stem-specific markers (Sox2, Nestin, GFAP) and a decrease in the fibroblast-specific gene (COL5A2) was observed after transfection with Msi1/Ngn2/MBD2, Msi1/Ngn2/Gadd45b, Msi1/MBD2 or Ngn2/MBD2 (Table 3). This study demonstrated that MBD2 Increased more reprogramming efficiency then GDA45b and showed that cytochalasin B had no effect of its own in the control cultures.

TABLE 3

RT-PCR analysis of relative expression of neuronal precursor cell markers such as nestin, Sox2, and GFAP after transfection of fibroblast cells with different combinations with or without the co-treatment with cytochalasin B. Relative expression of Sox2, nestin, and GFAP in NSLCs was increased after transfection with both transcription factors (Ngn2 and Msi1) with MBD2 as the DNA demethyaltor. As demonstrated, this upregulation of neural stem cell gene expression was associated with a decrease of CoL5A2, a specific gene for fibroblast cells.

| | COL5A2 | | FBN2 | | NES | | MAP2 | | TUBB3 | | SOX2 | | ACHE | | GFAP | |
|---|---|---|---|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| #1, +CytoB, Control | 1.00 | 0.07 | 1.00 | 0.01 | 1.00 | 0.04 | 1.00 | 0.05 | 1.00 | 0.05 | 1.00 | 0.05 | 1.00 | 0.10 | 1.00 | 0.11 |
| #2, −CytoB, Control | 1.00 | 0.03 | 1.00 | 0.08 | 1.00 | 0.00 | 1.00 | 0.09 | 1.00 | 0.09 | 1.15 | 0.80 | 1.01 | 0.18 | 1.00 | 0.01 |
| #3, +CytoB, Msi1, GAD45b | 0.85 | 0.04 | 0.75 | 0.02 | 0.60 | 0.01 | 0.29 | 0.01 | 0.44 | 0.00 | 22.39 | 5.26 | 0.81 | 0.19 | 10.14 | 0.15 |
| #4, −CytoB, Msi1, GAD45b | 0.87 | 0.03 | 1.81 | 0.09 | 1.84 | 0.04 | 2.31 | 0.00 | 2.09 | 0.03 | 20.28 | 5.33 | 1.99 | 0.74 | 6.03 | 0.05 |
| #5, +CytoB, Ngn2, GAD45b | 0.84 | 0.04 | 0.77 | 0.03 | 0.44 | 0.00 | 0.24 | 0.00 | 0.36 | 0.01 | 470.84 | 13.43 | 0.63 | 0.05 | 103.22 | 0.80 |
| #6, −CytoB, Ngn2, GAD45b | 0.75 | 0.07 | 1.97 | 0.02 | 1.83 | 0.00 | 4.40 | 0.16 | 2.02 | 0.10 | 789.33 | 60.35 | 1.70 | 0.13 | 110.48 | 4.90 |
| #7, +CytoB, Pax6, GAD45b | 0.74 | 0.12 | 1.08 | 0.00 | 0.89 | 0.01 | 0.51 | 0.00 | 0.63 | 0.04 | 1.64 | 0.98 | 0.86 | 0.12 | 2.49 | 0.21 |
| #8, −CytoB, Pax6, GAD45b | 0.66 | 0.04 | 2.41 | 0.09 | 2.70 | 0.03 | 4.96 | 0.30 | 3.48 | 0.07 | 0.46 | 0.33 | 2.97 | 1.04 | 0.43 | 0.09 |
| #9, +CytoB, Msi1, Ngn2, GAD45b | 0.14 | 0.01 | 0.28 | 0.01 | 1.30 | 0.03 | 4.07 | 0.11 | 0.84 | 0.00 | 54768.27 | 6709.56 | 0.81 | 0.24 | 3391.96 | 64.63 |
| #10, −CytoB, Msi1, Ngn2 GAD45b | 0.12 | 0.00 | 0.73 | 0.03 | 5.28 | 0.21 | 50.84 | 1.23 | 4.93 | 0.28 | 17400.66 | 822.88 | 3.58 | 0.10 | 1255.76 | 5.27 |
| #11, +CytoB, Msi1, Ngn2 MBD2 | 0.10 | 0.00 | 0.26 | 0.01 | 1.11 | 0.01 | 3.69 | 0.09 | 0.76 | 0.00 | 55588.41 | 1331.20 | 0.55 | 0.14 | 2849.96 | 261.51 |
| #12, −CytoB, Msi1, Ngn2 MBD2 | 0.44 | 0.01 | 1.47 | 0.06 | 5.49 | 0.14 | 47.30 | 0.11 | 5.50 | 0.31 | 14587.46 | 789.19 | 3.90 | 0.13 | 1424.04 | 39.29 |
| #13, +CytoB, GAD45b | 1.11 | 0.04 | 1.09 | 0.06 | 0.92 | 0.08 | 0.68 | 0.01 | 0.82 | 0.03 | 63.93 | 2.81 | 1.19 | 0.17 | 17.43 | 1.86 |
| #14, −CytoB, GAD45b | 0.94 | 0.01 | 2.22 | 0.00 | 2.82 | 0.02 | 6.49 | 0.30 | 4.01 | 0.05 | 6.12 | 0.61 | 2.34 | 0.17 | 1.42 | 0.10 |
| #15, +CytoB, MBD2 | 0.83 | 0.00 | 0.83 | 0.05 | 0.36 | 0.01 | 0.16 | 0.01 | 0.36 | 0.00 | 3.42 | 3.74 | 0.63 | 0.37 | 2.18 | 0.12 |
| #16, −CytoB, MBD2 | 0.68 | 0.02 | 1.55 | 0.04 | 1.57 | 0.05 | 1.47 | 0.01 | 2.00 | 0.00 | 0.52 | 0.29 | 1.45 | 0.15 | 0.55 | 0.04 |
| #17, +CytoB, Msi1, Ngn2 | 1.10 | 0.01 | 1.16 | 0.03 | 1.37 | 0.01 | 1.12 | 0.06 | 0.86 | 0.06 | 5.59 | 1.48 | 1.07 | 0.27 | 1.70 | 0.46 |
| #18, −CytoB, Msi1, Ngn2 | 0.93 | 0.04 | 2.52 | 0.10 | 3.48 | 0.01 | 9.01 | 0.02 | 4.55 | 0.18 | 1.78 | 1.46 | 3.83 | 0.42 | 0.59 | 0.01 |
| #19, +CytoB, Msi1, MBD2 | 0.20 | 0.03 | 0.36 | 0.01 | 1.25 | 0.05 | 6.68 | 0.31 | 0.72 | 0.02 | 66592.29 | 3481.89 | 2.57 | 0.03 | 4450.08 | 131.85 |
| #20, −CytoB, Msi1, MBD2 | 0.12 | 0.00 | 0.64 | 0.03 | 4.70 | 0.22 | 77.51 | 0.11 | 4.12 | 0.11 | 19128.03 | 1542.00 | 8.14 | 0.13 | 999.22 | 24.75 |
| #21, +CytoB, Ngn2, MBD2 | 0.17 | 0.01 | 0.28 | 0.00 | 1.16 | 0.04 | 5.73 | 0.06 | 0.62 | 0.00 | 67945.51 | 3000.74 | 2.15 | 0.04 | 4736.83 | 11.92 |
| #22, −CytoB, Ngn2, MBD2 | 0.17 | 0.00 | 0.78 | 0.03 | 4.32 | 0.08 | 68.89 | 5.26 | 4.01 | 0.04 | 16570.91 | 92.96 | 7.04 | 0.53 | 1427.13 | 13.19 |

TABLE 3-continued

RT-PCR analysis of relative expression of neuronal precursor cell markers such as nestin, Sox2, and GFAP after transfection of fibroblast cells with different combinations with or without the co-treatment with cytochalasin B. Relative expression of Sox2, nestin, and GFAP in NSLCs was increased after transfection with both transcription factors (Ngn2 and Msi1) with MBD2 as the DNA demethyaltor. As demonstrated, this upregulation of neural stem cell gene expression was associated with a decrease of CoL5A2, a specific gene for fibroblast cells.

| | COL5A2 | | FBN2 | | NES | | MAP2 | | TUBB3 | | SOX2 | | ACHE | | GFAP | |
|---|---|---|---|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| #23, +CytoB, Msi1 | 0.71 | 0.05 | 0.79 | 0.06 | 0.87 | 0.01 | 0.63 | 0.06 | 0.67 | 0.04 | 2.86 | 0.70 | 1.08 | 0.08 | 2.08 | 0.11 |
| #24, −CytoB, Msi1 | 0.66 | 0.04 | 1.92 | 0.17 | 2.03 | 0.02 | 2.77 | 0.02 | 2.68 | 0.02 | 0.32 | 0.12 | 1.85 | 0.65 | 0.58 | 0.04 |

Immunohistochemical Analysis

Fluorescent immunohistochemical staining was performed as previously described in Example I. Table 4 shows the percentage of Nestin and Sox2 In each condition, with the highest percentage of Sox2 (38.18±1.75%) and nestin (28.18±2.77%) positive cells observed after transfecting the cells simultaneously with both neurogenic transcription factors and in the presence of a DNA demethylator and cytochalasin B. A slight increase of Sox2 positive cells (10.42±10.27%) and nestin positive cells (4.85±1.10%) was detected following transfection with one transcription factor Msi1 and MBD2. Same tendency of nestin and Sox2 positive cells was observed following transfection with Ngn2 and MBD2. Disrupting the cell cytoskeleton with Cytochalasin B significantly enhanced reprogramming, but had no reprogramming effect on its own (Table 4).

MeCP2, AICDA). Another assay was performed to assess the effect of nestin on the reprogramming efficiency; therefore cells were transfected with nestin individually or in combination with one vector containing one neurogenic factor (Msi1 or Ngn2) or both neurogenic factors in the presence of MBD2. Cells were cultured following transfection in the presence of proliferation medium supplemented with EGF (20 ng (ml), FGF (20 ng/ml), and Noggin (20 ng/ml) with and without VPA (1 mM) treatment for 12 days at 37° C., 5% $CO_2$ and 5% $O_2$.

Gene expression analysis and immunohistochemistry was performed to analyse neural specific gene and protein expression (βIII-tubulin, GFAP, Sox2, Nestin) as described in Example II. Transfecting cells with Msi1 and Ngn2 in the

TABLE 4

Percentage of positive cells for Sox2 and nestin after transfection of fibroblast cells with different expression vectors with or without the presence of cytochalasin B. After transfection the cells were cultured in proliferation medium (StemCell Technologies) supplemented by EGF (20 ng/ml, Peprotech) and FGF (20 ng/ml, Peprotech) for two weeks at 37° C./5% $CO_2$/5% $O_2$. The percentage of immunopositive cells was determined by Cellomics ™ and represented as mean ± SD (n = 3-5).

| | % of Sox2 positive cells | | % of Nestin positive cells | |
|---|---|---|---|---|
| | +CytoB | −Cyto B | +CytoB | −CytoB |
| Untransfected cells | 0.02 ± 0.01 | 0.01 ± 0.00 | 0.14 ± 0.04 | 0.11 ± 0.09 |
| Ngn2 | 0.35 ± 0.36 | 0.15 ± 0.05 | 2.34 ± 0.99 | 1.04 ± 0.21 |
| Msi1 | 0.23 ± 0.15 | 0.12 ± 0.09 | 1.95 ± 0.11 | 1.11 ± 0.18 |
| Gadd45b | 0.30 ± 0.17 | 0.29 ± 0.11 | 4.94 ± 0.25 | 2.33 ± 0.42 |
| MBD2 | 0.22 ± 0.13 | 0.22 ± 0.11 | 2.8 ± 0.11 | 1.53 ± 0.6 |
| Msi1/Ngn2 | 0.19 ± 0.13 | 0.32 ± 0.05 | 1.91 ± 0.56 | 2.59 ± 1.28 |
| Msi1/MBD2 | 10.42 ± 10.27 | 8.84 ± 11.63 | 4.85 ± 1.10 | 2.06 ± 0.08 |
| Msi1/Gadd45b | 0.06 ± 0.01 | 0.14 ± 0.17 | 0.55 ± 0.06 | 0.24 ± 0.11 |
| Ngn2/MBD2 | 11.17 ± 0.08 | 9.07 ± 11.31 | 5.7 ± 0.10 | 2.18 ± 0.23 |
| Ngn2/GAdd45b | 0.29 ± 0.11 | 0.95 ± 0.17 | 1.17 ± 0.54 | 0.98 ± 0.25 |
| Msi1/Ngn2/MBD2 | 38.18 ± 1.75 | 22.03 ± 1.90 | 28.18 ± 2.77 | 14.54 ± 0.45 |
| Msi1/Ngn2/Gadd45b | 22.65 ± 5.03 | 18.54 ± 9.40 | 18.72 ± 6.26 | 8.70 ± 4.51 |

Various DNA demethylators were tested as well for their effect on reprogramming efficiency. Cells were co-transfected with one vector (MSII/NGN2) containing two neurogenic pCMV6-Msi1-Ngn2 factors with various DNA demethylators. Simultaneously another neurogenic factor was tested for its effect on cells de-differentiation towards NSCs, pCMV-XL-Nestin individually or in combination with pCMV-Msi1-Ngn2, pCMV-XL5-Msi1, or pCMV-XL4-Ngn2 in the presence of MBD2 as previously described in Example II.

Cells were co-transfected pCMV-Msi1-Ngn2 with different DNA demethylators (MBD1, MBD2, MBD3, MBD4, presence of various DNA demethylators revealed and confirm previous data showing that the among various DNA demethylators used in this study. MBD2 promotes the expression of neural stem genes (Sox2, GFAP, Nestin) as shown in Table 5. Furthermore, transfecting cells with nestin with and without the presence of one neurogenic factor had no effect on the reprogramming efficiency into neural stem-like cells. However co-transfection with nestin and Msi1/Ngn2/MBD2 enhanced the expression of neural stem cells genes and this increase was more pronounced in the presence of VPA.

TABLE 5

RT-PCR analysis of relative expression of neuronal precursor cell markers such as nestin, Sox2, βIII-tubulin, and GFAP after transfection of fibroblast cells with various combinations of pCMV-Msi1-Ngn2 (MSI1/NGN2), pCMV-XL5-Msi1, pCMV-XL4-Ngn2, pCMV-XL-Nestin with different combinations of DNA demethylators, with and without the co-treatment with VPA.

| | TUBB3 | | GFAP | | SOX2 | | NES | |
|---|---|---|---|---|---|---|---|---|
| | Rel. Exp. | Std. Dev. | Rel. Exp. | Std. Dev. | Rel. Exp. | Std. Dev. | Rel. Exp. | Std. Dev. |
| Day 12, Untransfected (−VPA) | 1.00 | 0.11 | 1.00 | 0.05 | 1.01 | 0.16 | 1.00 | 0.13 |
| Day 12, Untransfected (+VPA) | 1.00 | 0.03 | 1.00 | 0.06 | 1.00 | 0.00 | 1.00 | 0.02 |
| Day 12, MSI1/NGN2/MBD1 (−VPA) | 0.96 | 0.06 | 2.69 | 0.13 | 1.15 | 0.49 | 0.46 | 0.02 |
| Day 12, MSI1/NGN2/MBD1 (+VPA) | 1.10 | 0.06 | 2.22 | 0.06 | 0.80 | 0.01 | 0.84 | 0.02 |
| Day 12, MSI1/NGN2/MBD2 (−VPA) | 123.52 | 0.06 | 1638.53 | 99.86 | 61467.29 | 1487.21 | 31.77 | 0.17 |
| Day 12, MSI1/NGN2/MBD2 (+VPA) | 232.00 | 0.08 | 1889.30 | 42.39 | 72022.15 | 7894.41 | 42.69 | 0.14 |
| Day 12, MSI1/NGN2/MBD3 (−VPA) | 0.92 | 0.07 | 3.98 | 0.59 | 28.05 | 4.67 | 0.56 | 0.01 |
| Day 12, MSI1/NGN2/MBD3 (+VPA) | 1.23 | 0.05 | 1.66 | 0.18 | 11.31 | 2.35 | 0.87 | 0.02 |
| Day 12, MSI1/NGN2/MBD4 (−VPA) | 0.85 | 0.01 | 4.80 | 0.23 | 5.42 | 5.20 | 0.62 | 0.00 |
| Day 12, MSI1/NGN2/MBD4 (+VPA) | 0.95 | 0.01 | 1.57 | 0.16 | 2.27 | 0.04 | 0.79 | 0.03 |
| Day 12, MSI1/NGN2/MeCP2 (−VPA) | 1.11 | 0.06 | 3.80 | 0.38 | 6.54 | 6.45 | 0.69 | 0.01 |
| Day 12, MSI1/NGN2/MeCP2 (+VPA) | 1.37 | 0.09 | 1.63 | 0.45 | 10.53 | 10.49 | 1.07 | 0.01 |
| Day 12, MSI1/NGN2/AICDA (−VPA) | 1.07 | 0.04 | 4.59 | 0.02 | 0.65 | 0.01 | 0.74 | 0.02 |
| Day 12, MSI1/NGN2/AICDA (+VPA) | 1.10 | 0.01 | 2.37 | 0.29 | 1.21 | 0.16 | 0.91 | 0.04 |
| Day 12, Msi1/MBD2 (−VPA) | 1.31 | 0.17 | 3.78 | 0.49 | 0.70 | 0.02 | 0.78 | 0.00 |
| Day 12, Msi1/MBD2 (+VPA) | 1.36 | 0.07 | 1.75 | 0.31 | 1.26 | 0.03 | 1.15 | 0.03 |
| Day 12, Ngn2/MBD2 (−VPA) | 0.85 | 0.06 | 2.93 | 0.51 | 0.79 | 0.05 | 0.58 | 0.02 |
| Day 12, Ngn2/MBD2 (+VPA) | 1.41 | 0.05 | 1.60 | 0.11 | 2.30 | 0.06 | 1.03 | 0.03 |
| Day 12, Nes/Msi1 (−VPA) | 0.84 | 0.03 | 3.21 | 0.72 | 0.76 | 0.01 | 0.51 | 0.01 |
| Day 12, Nes/Msi1 (+VPA) | 0.86 | 0.09 | 1.82 | 0.30 | 2.14 | 1.02 | 0.94 | 0.01 |
| Day 12, Nes/Ngn2 (−VPA) | 0.69 | 0.05 | 2.88 | 0.32 | 0.99 | 0.10 | 0.57 | 0.02 |
| Day 12, Nes/Ngn2 (+VPA) | 0.88 | 0.01 | 1.53 | 0.19 | 2.71 | 0.02 | 0.83 | 0.03 |
| Day 12, Nes/MSI1/NGN2/MBD2 (−VPA) | 111.58 | 0.04 | 1423.56 | 82.87 | 72069.27 | 624.51 | 51.52 | 0.12 |
| Day 12, Nes/MSI1/NGN2/MBD2 (+VPA) | 321.00 | 0.04 | 2600.14 | 1.90 | 88932.00 | 708.72 | 82.74 | 0.18 |
| Day 12, Nes/MSI1/NGN2 (−VPA) | 0.74 | 0.11 | 2.60 | 0.28 | 1.98 | 0.97 | 0.55 | 0.01 |
| Day 12, Nes/MSI1/NGN2 (+VPA) | 0.86 | 0.00 | 1.70 | 0.49 | 1.70 | 0.04 | 0.88 | 0.05 |
| Day 12, Nes/MBD2 (−VPA) | 0.76 | 0.12 | 3.15 | 0.17 | 0.87 | 0.03 | 0.44 | 0.00 |
| Day 12, Nes/MBD2 (+VPA) | 0.87 | 0.03 | 2.05 | 0.07 | 2.66 | 1.64 | 0.91 | 0.00 |
| Day 12, Nes/Msi1/MBD2 (−VPA) | 0.81 | 0.05 | 3.41 | 0.66 | 1.11 | 0.01 | 0.58 | 0.01 |
| Day 12, Nes/Msi1/MBD2 (+VPA) | 1.01 | 0.13 | 2.43 | 0.07 | 3.27 | 0.26 | 0.93 | 0.02 |
| Day 12, Nes/Ngn2/MBD2 (−VPA) | 1.19 | 0.07 | 5.71 | 1.30 | 4.11 | 0.07 | 0.91 | 0.04 |
| Day 12, Nes/Ngn2/MBD2 (+VPA) | 1.29 | 0.03 | 2.98 | 0.66 | 21.20 | 0.42 | 1.65 | 0.02 |

Immunohistochemistry analysis performed in parallel with RT-PCR data indicated that positive Sox2 cells were undetectable when transfecting the cells with Msi1/Ngn2 in the presence of MBD1, MBD3, MBD4, MeCP1, or AICADA (Table 6) and that among the different types of DNA demethylator genes tested only MBD2 plays a significant positive role in the reprogramming efficiency of HFF towards NSLCs when using the above neurogenic genes. Immunohistochemistry analysis revealed a small increase of immunopositive Sox2 cells (89.49±3.18) after co-transfecting the cells with nestin and Msi1/Ngn2 in the presence of MBD2 (Table 6).

TABLE 6

Percentage of positive cells for Sox2 after transfection of fibroblast cells with different expression vectors with or without the presence of various DNA demethylators. After transfection the cells were cultured in proliferation medium (StemCell Technologies) supplemented by EGF (20 ng/ml, Peprotech) and FGF (20 ng/ml, Peprotech) for two weeks at 37° C./5% $CO_2$/5%$O_2$. The percentage of immunopositive cells was determined by Cellomics™ and represented as mean ± SD (n = 3-5).

| | % Sox2 positive ± stdv |
|---|---|
| HFF untransfected | 0.13 ± 0.12 |
| Msi-Ngn2 + MBD1 | 0.92 ± 0.13 |

TABLE 6-continued

Percentage of positive cells for Sox2 after transfection of fibroblast cells with different expression vectors with or without the presence of various DNA demethylators. After transfection the cells were cultured in proliferation medium (StemCell Technologies) supplemented by EGF (20 ng/ml, Peprotech) and FGF (20 ng/ml, Peprotech) for two weeks at 37° C./5% $CO_2$/5%$O_2$. The percentage of immunopositive cells was determined by Cellomics ™ and represented as mean ± SD (n = 3-5).

|  | % Sox2 positive ± stdv |
|---|---|
| Msi-Ngn2 + MBD2 | 79.44 ± 9.86 |
| Msi-Ngn2 + MBD3 | 1.22 ± 0.82 |
| Msi-Ngn2 + MBD4 | 0.59 ± 0.03 |
| Msi-Ngn2 + MeCP2 | 1.10 ± 0.25 |
| Msi-Ngn2 + AICDA | 0.69 ± 0.28 |
| Msi + MBD2 | 0.79 ± 0.28 |
| Ngn2 + MBD2 | 1.74 ± 1.01 |
| Nestin + Msi | 0.91 ± 0.01 |
| Nestin + Ngn2 | 2.16 ± 1.44 |
| Nestin + MSI1/NGN2 + MBD2 | 89.49 ± 3.18 |
| Nestin + MSI1/NGN2 | 10.20 ± 0.21 |
| Nestin + MBD2 | 0.00 ± 0.00 |
| Nestin + Msi + MBD2 | 8.45 ± 0.08 |
| Nestin + Ngn2 + MBD2 | 5.71 ± 0.66 |

Another study was designed to test the effect of various neurogenic genes on the reprogramming efficiency towards neural stem-like cells. HFF cells were cultured as described in Example I, and transfected using the Nucleofector™ 96-well Shuttle™ Device (Lonza) following procedure described in Example IV, except for the untreated HFF control and the untransfected HFF control (for determining the effect of the complete media & compound treatments on the cells). The cells that had been pre-treated with VPA and 5-Aza and the untreated cells were transfected with the mixes of DNA as described in Table 7. The cells were plated on Laminin-coated plates and incubated at 37° C., 5% $CO_2$. Media was changed daily according to Table 7. Cells were analysed at day 3, 7, 12 by immunohistochemistry analysis and at Day 9 by gene array for multipotent and pluripotent gene expression.

Gene Array Analysis

An additional batch of cells treated according to 0a and 1a in Table 7 was analyzed at Day 9, along with HFFs, hNPCs, and passage 5 NSLCs (frozen from previous experiments from Example III) by the Pluripotency Gene Array (ABI) (Tables 8a and b) and a set of genes (Table 8c) to determine the gene expression profile of select pluripotency, ectoderm, endoderm, mesoderm, and neural lineage genes in passage 1 and passage 5 NSLCs compared to HFFs (from which they were created) and normal human neuroprogenitor cells (hNPCs). The results in Table 8 indicate that all the genes related to neural stem cells (some of the significantly expressed pluripotency markers and mesendoderm markers are also expressed in neural stem cells) and the neural lineage were significantly expressed in NSLCs as opposed to HFFs, and the expression pattern was a bit different from hNPCs indicating that NSLCs are similar to, but not identical, to the hNPCs tested. Passage 5 NSLCs 5 had a higher expression of stemness genes than Passage 1 NSLCs. hNPCs had a higher expression of neuronally committed genes than NSLCs, indicting their neuroprogenitor status versus the greater stemness status of NSLCs.

TABLE 7

Plasmids and media composition from day 1 to day 12.

|  | From day −2 to day 0 | Plasmids transfected at day 0 | From day 1 to day 3 | From day 3 to day 4 | From day 4 to day 12 |
|---|---|---|---|---|---|
| 0a | Untreated | No plasmid | Neural proliferation medium + Egf + Fgf-2 | Neural proliferation medium + Egf + Fgf-2 | Neural proliferation medium + Egf + Fgf-2 |
| 1a | Untreated | Msi1/Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 1b | Untreated | Msi1/Ngn2 + pCMV6-XL5-MBD2 | Neural proliferation medium + Egf + Fgf-2 | Neural proliferation medium + Egf + Fgf-2 | Neural proliferation medium + Egf + Fgf-2 + SHH |
| 1c | Untreated | Msi1/Ngn2 + pCMV6-XL5-MBD2 | Neural proliferation medium + Egf + Fgf-2 + Noggin | Neural proliferation medium + Egf + Fgf-2 + Noggin | Neural proliferation medium + Egf + Fgf-2 + Noggin (day 1 to day 7)/Forskolin (day 7 to day 12) |
| 1d | Untreated | Msi1/Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 1e | Untreated | Msi1/Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 1f | Untreated | Msi1/Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 2 | Untreated | Msi1/Ngn2 + pCMV6-XL5-MBD2 | Neural proliferation medium + Egf + Fgf-2 + CytoB | Neural proliferation medium + Egf + Fgf-2 + CytoB | Neural proliferation medium + Egf + Fgf-2 |
| 3 | Untreated | Msi1/Ngn2 | Neural proliferation medium + Egf + Fgf-2 + VPA + 5-Aza | Neural proliferation medium + Egf + Fgf-2 | Neural proliferation medium + Egf + Fgf-2 |
| 4 | Untreated | Msi1/Ngn2 | Neural proliferation medium + Egf + Fgf-2 | Neural proliferation medium + Egf + Fgf-2 | Neural proliferation medium + Egf + Fgf-2 |
| 5 | Untreated | pCMV6-XL5-Musashi | Neural proliferation medium + Egf + Fgf-2 | Neural proliferation medium + Egf + Fgf-2 | Neural proliferation medium + Egf + Fgf-2 |
| 6 | Untreated | pCMV6-XL5-Musashi | Neural proliferation medium + Egf + Fgf-2 + Noggin | Neural proliferation medium + Egf + Fgf-2 + Noggin | Neural proliferation medium + Egf + Fgf-2 + Noggin + Forskolin |
| 7 | Untreated | pCMV6-XL5-Musashi | Neural proliferation medium + Egf + Fgf-2 + VPA + 5-Aza | Neural proliferation medium + Egf + Fgf-2 | Neural proliferation medium + Egf + Fgf-2 |
| 8 | Untreated | pCMV6-XL5-Musashi | Neural proliferation medium + Egf + Fgf-2 + Noggin + VPA + 5-Aza | Neural proliferation medium + Egf + Fgf-2 + Noggin | Neural proliferation medium + Egf + Fgf-2 + Noggin + Forskolin |

TABLE 7-continued

Plasmids and media composition from day 1 to day 12.

| | From day −2 to day 0 | Plasmids transfected at day 0 | From day 1 to day 3 | From day 3 to day 4 | From day 4 to day 12 |
|---|---|---|---|---|---|
| 9 | Untreated | pCMV6-XL5-ZIC1 + pCMV6-XL4-Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 10 | Untreated | pCMV6-XL5-SOX1 + pCMV6-XL4-Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 11 | Untreated | pCMV6-XL5-Sox2 + pCMV6-XL4-Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 12 | Untreated | pCMV6-XL5-Nanog + pCMV6-XL4-Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 13 | Untreated | pCMV6-XL4-Oct4 + pCMV6-XL4-Ngn2 + pCMV6-XL5-MBD2 | Neural proliferation medium + Egf + Fgf-2 | Neural proliferation medium + Egf + Fgf-2 | Neural proliferation medium + Egf + Fgf-2 |
| 14 | VPA + 5-Aza pre-treated | Msi1/Ngn2 | Neural proliferation medium + Egf + Fgf-2 | Neural proliferation medium + Egf + Fgf-2 | Neural proliferation medium + Egf + Fgf-2 |
| 15 | VPA + 5-Aza pre-treated | pCMV6-XL5-Musashi | Neural proliferation medium + Egf + Fgf-2 + VPA + 5-Aza | Neural proliferation medium + Egf + Fgf-2 | Neural proliferation medium + Egf + Fgf-2 |
| 16 | VPA + 5-Aza pre-treated | pCMV6-XL5-Musashi | Neural proliferation medium + Egf + Fgf-2 + Noggin + VPA + 5-Aza | Neural proliferation medium + Egf + Fgf-2 + Noggin | Neural proliferation medium + Egf + Fgf-2 + Noggin + Forskolin |
| 17 | VPA + 5-Aza pre-treated | pCMV6-XL5-Musashi + pCMV6-XL5-MBD2 | Neural proliferation medium + Egf + Fgf-2 + Noggin + VPA + 5-Aza | Neural proliferation medium + Egf + Fgf-2 + Noggin | Neural proliferation medium + Egf + Fgf-2 + Noggin + Forskolin |
| 18 | VPA + 5-Aza pre-treated | pCMV6-XL4-Ngn2 | Neural proliferation medium + Egf + Fgf-2 + Noggin + VPA + 5-Aza | Neural proliferation medium + Egf + Fgf-2 + Noggin | Neural proliferation medium + Egf + Fgf-2 + Noggin + Forskolin |
| 19 | VPA + 5-Aza pre-treated | pCMV6-XL5-MBD2 | Neural proliferation medium + Egf + Fgf-2 + Noggin + VPA + 5-Aza | Neural proliferation medium + Egf + Fgf-2 + Noggin | Neural proliferation medium + Egf + Fgf-2 + Noggin + Forskolin |
| 20 | VPA + 5-Aza pre-treated | Ngn2 + pCMV6-XL5-MBD2 | Neural proliferation medium + Egf + Fgf-2 + Noggin + VPA + 5-Aza | Neural proliferation medium + Egf + Fgf-2 + Noggin | Neural proliferation medium + Egf + Fgf-2 + Noggin + Forskolin |
| 21 | VPA + 5-Aza pre-treated | No plasmid | Neural proliferation medium + Egf + Fgf-2 + Noggin + VPA + 5-Aza | Neural proliferation medium + Egf + Fgf-2 + Noggin | Neural proliferation medium + Egf + Fgf-2 + Noggin + Forskolin |

* Immunohistochemistry analysis performed in parallel with RT-PCR data indicated among all the combinations in this experiment where no cytochalasin B was used, positive Sox2 cells were detectable only in cells transfected with Msi1/Ngn2 with and without MBD2.

TABLE 8a

Results for Human Stem Cell Pluripotency Array (n = 4 for each sample) - Embryonic Stem Cell Markers, Germ Cell Markers and Trophoblast Markers.

| Gene | Untreated HFF (Passage 8) Rel. Exp. | Std. Dev. | Untransfected HFF (Day 9) Rel. Exp. | Std. Dev. | hNPC neurospheres (Passage 4) Rel. Exp. | Std. Dev. | MSI1/NGN2/MBD2-transfected HFF (Day 9) (NSLC, Passage 1) Rel. Exp. | Std. Dev. | Neural stem-like cells, NSLC (Passage 5) Rel. Exp. | Std. Dev. |
|---|---|---|---|---|---|---|---|---|---|---|
| Embryonic Stem cell markers | | | | | | | | | | |
| BRIX | 1.03 | 0.30 | 0.47 | 0.10 | 0.78 | 0.22 | 0.78 | 0.25 | 0.83 | 0.10 |
| CD9 | 1.01 | 0.18 | 2.46* | 0.62 | 1.86 | 0.29 | 2.24* | 0.19 | 1.00 | 0.39 |
| COMMD3 | 1.08 | 0.53 | 0.94 | 0.36 | 0.94 | 0.40 | 0.98 | 0.40 | 1.05 | 0.59 |
| DNMT3B | 1.07 | 0.50 | 0.34* | 0.14 | 2.96* | 0.84 | 1.90 | 0.41 | 0.35 | 0.34 |
| EBAF/LEFTY2 | 1.00 | 0.00 | 2.10 | 0.00 | 7.95 | 4.60 | 7.79 | 4.88 | 70.56* | 26.12 |
| FGF4 | 1.00 | 0.00 | 2.10 | 0.00 | 1.44 | 0.00 | 1.54 | 0.00 | 1.37 | 0.00 |
| FOXD3 | 1.00 | 0.00 | 2.10 | 0.00 | 1.44 | 0.00 | 7.13 | 11.18 | 222.41* | 63.43 |
| GABRB3 | 1.06 | 0.38 | 4.22* | 0.71 | 66.65* | 12.52 | 40.01* | 4.54 | 1.62 | 0.98 |
| GAL | 1.00 | 0.04 | 9.73* | 0.32 | 0.03* | 0.01 | 4.25* | 0.46 | 2.89* | 0.83 |
| GBX2 | 1.00 | 0.09 | 0.04 | 0.05 | 45.28* | 4.59 | 90.92* | 12.14 | 55.22* | 2.36 |
| GDF3 | 1.00 | 0.00 | 2.10 | 0.00 | 1.44 | 0.00 | 1.54 | 0.00 | 1.37 | 0.00 |
| GRB7 | 1.02 | 0.24 | 0.30* | 0.16 | 0.05* | 0.04 | 0.29* | 0.08 | 0.06* | 0.08 |
| IFITM1 | 1.01 | 0.17 | 63.96* | 6.04 | 0.04* | 0.01 | 21.80* | 4.31 | 3.35* | 0.63 |
| IFITM2 | 1.00 | 0.12 | 3.84* | 0.89 | 0.02* | 0.00 | 0.65 | 0.11 | 0.43* | 0.09 |
| IL6ST | 1.01 | 0.21 | 2.19* | 0.39 | 0.85 | 0.14 | 1.59 | 0.26 | 0.75 | 0.06 |
| IMP2 | 1.11 | 0.66 | 1.65 | 0.92 | 1.06 | 0.48 | 0.78 | 0.26 | 1.96 | 0.97 |
| KIT | 1.02 | 0.26 | 1.15 | 0.30 | 0.02* | 0.00 | 0.31* | 0.09 | 0.00* | 0.00 |

TABLE 8a-continued

Results for Human Stem Cell Pluripotency Array (n = 4 for each sample) - Embryonic Stem Cell Markers, Germ Cell Markers and Trophoblast Markers.

| Gene | Untreated HFF (Passage 8) | | Untransfected HFF (Day 9) | | hNPC neurospheres (Passage 4) | | MSI1/NGN2/MBD2-transfected HFF (Day 9) (NSLC, Passage 1) | | Neural stem-like cells, NSLC (Passage 5) | |
|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. |
| LEFTB | 1.61 | 1.15 | 12.28* | 7.84 | 5.45 | 3.15 | 5.58 | 2.65 | 8.96* | 4.12 |
| LIFR | 2.29 | 3.57 | 13.51 | 16.55 | 6.31 | 7.24 | 12.98 | 9.81 | 2.85 | 4.31 |
| LIN28 | 4.69 | 8.62 | 5.25 | 8.88 | 28.38* | 19.25 | 26.97* | 8.68 | 32.13* | 14.32 |
| NANOG | 1.71 | 1.97 | 18.61 | 16.43 | 64.94* | 28.32 | 70.87* | 9.88 | 5.87 | 3.52 |
| NOG | 1.03 | 0.27 | 0.18* | 0.08 | 0.18* | 0.06 | 0.22* | 0.06 | 0.02* | 0.00 |
| NR5A2 | 2.04 | 2.05 | 6.85 | 8.80 | 0.38 | 0.00 | 3.89 | 4.36 | 0.36 | 0.00 |
| NR6A1 | 1.11 | 0.66 | 1.37 | 0.31 | 5.08* | 0.37 | 2.71* | 0.63 | 2.04* | 0.17 |
| PODXL | 1.00 | 0.07 | 0.01* | 0.01 | 0.80 | 0.11 | 2.09* | 0.04 | 6.49* | 0.64 |
| POU5F1 | 1.01 | 0.13 | 0.27* | 0.17 | 0.89 | 0.09 | 0.71 | 0.09 | 0.19* | 0.06 |
| PTEN | 1.00 | 0.02 | 2.68* | 0.29 | 0.87 | 0.04 | 1.07 | 0.12 | 0.80 | 0.14 |
| RESET | 1.01 | 0.12 | 1.53 | 0.17 | 0.94 | 0.18 | 1.04 | 0.21 | 1.10 | 0.24 |
| SEMA3A | 1.00 | 0.11 | 1.99 | 0.19 | 0.66 | 0.05 | 1.05 | 0.11 | 0.90 | 0.16 |
| SFRP2 | 1.11 | 0.56 | 122.57* | 14.57 | 3480.98* | 702.37 | 1500.84* | 272.46 | 2.75 | 2.85 |
| SOX2 | 1.00 | 0.00 | 2.45 | 0.70 | 127594.46* | 11326.91 | 88615.76* | 15003.70 | 137424.37* | 26622.02 |
| TDGF1 | 1.41 | 1.28 | 2.92 | 0.68 | 6.13 | 1.52 | 5.46 | 1.95 | 2.20 | 1.51 |
| TERT | 1.00 | 0.00 | 2.10 | 0.00 | 10.81 | 18.75 | 10.74 | 18.41 | 6506.88* | 893.84 |
| TFCP2L1 | 1.00 | 0.00 | 2.10 | 0.00 | 7.84 | 12.80 | 32.49 | 10.01 | 1.37 | 0.00 |
| UTF1 | 1.00 | 0.00 | 8.21 | 12.23 | 27.86 | 19.24 | 1.54 | 0.00 | 30.68 | 25.94 |
| XIST | 1.00 | 0.00 | 2.10 | 0.00 | 24609.46* | 4337.83 | 22637.95* | 3988.10 | 1.37 | 0.00 |
| ZFP42 | 1.24 | 1.06 | 12.38 | 12.58 | 1.41 | 0.78 | 2.01 | 1.85 | 1.76 | 0.93 |
| Germ cell markers | | | | | | | | | | |
| DDX4 | 1.00 | 0.00 | 2.10 | 0.00 | 1.44 | 0.00 | 5.84 | 8.60 | 19.11 | 20.49 |
| SYCP3 | 1.58 | 1.95 | 11.97 | 8.01 | 11.12 | 3.46 | 15.46 | 11.65 | 2.25 | 2.85 |
| Trophoblast markers | | | | | | | | | | |
| CDX2 | 1.00 | 0.00 | 2.10 | 0.00 | 1.44 | 0.00 | 1.54 | 0.00 | 1.37 | 0.00 |
| CGB | 1.02 | 0.24 | 2.08* | 0.74 | 0.15* | 0.16 | 0.57 | 0.41 | 0.09* | 0.17 |
| EOMES | 1.51 | 1.14 | 0.33 | 0.00 | 0.71 | 0.97 | 0.24 | 0.00 | 0.77 | 1.12 |
| GCM1 | 2.61 | 2.80 | 0.42 | 0.00 | 3.25 | 5.92 | 5.68 | 1.44 | 1.47 | 2.38 |
| KRT1 | 1.00 | 0.00 | 2.10 | 0.00 | 1.44 | 0.00 | 1.54 | 0.00 | 1.37 | 0.00 |

For Relative Expression calculations, each sample was normalized to the average Ct of the 6 housekeeping genes (ACTB, 18S, CTNNB1, EEF1A1, GAPD, RAF1), and calibrated to the Untreated HFF (Passage 8) control.
Relative Expression values with asterisk (*) indicate values with significant up or down-regulation (>2-fold or <0.5-fold).
For these samples, for Ct values <35 is considered that the expression of the gene is adequate for quantification.
For the Relative Expression values that are >2-fold or <0.5-fold but without asterisk, the values could have significant error due to the low expression of the gene (Ct > 35), and thus the up or down-regulation could be merely a result of the high standard deviation of the high Ct values of the genes, or fluctuations in the housekeeping genes.
As for the Relative Expression values that are between 0.5-fold and 2-fold, it indicates no significant change in the expression of the gene for these samples.

TABLE 8b

Results for Human Stem Cell Pluripotency Array (n = 4 for each sample) - Ectoderm, Endoderm and Mesoderm Markers.

| Gene | Untreated HFF (Passage 8) | | Untransfected HFF (Day 9) | | hNPC neurospheres (Passage 4) | | MSI1/NGN2/MBD2-transfected HFF (Day 9) (NSLC, Passage 1) | | Neural stem-like cells, NSLC (Passage 5) | |
|---|---|---|---|---|---|---|---|---|---|---|
| | Rel. Exp. | Std. Dev. | Rel. Exp. | Std. Dev. | Rel. Exp. | Std. Dev. | Rel. Exp. | Std Dev. | Rel. Exp. | Std. Dev. |
| Ectoderm markers | | | | | | | | | | |
| CRABP2 | 1.04 | 0.35 | 26.14* | 4.28 | 0.01* | 0.01 | 21.11* | 2.80 | 0.21* | 0.05 |
| FGF5 | 1.01 | 0.15 | 0.21* | 0.07 | 0.00* | 0.00 | 0.10* | 0.02 | 0.00* | 0.00 |
| GFAP | 1.22 | 0.84 | 9.89* | 5.46 | 798.04* | 162.37 | 487.99* | 79.84 | 12052.09* | 2984.71 |
| ISL1 | 1.01 | 0.12 | 2.19* | 0.27 | 0.02* | 0.02 | 0.42* | 0.08 | 0.00* | 0.00 |
| NES | 1.10 | 0.58 | 3.19* | 0.95 | 6.78* | 0.95 | 3.84* | 0.19 | 7.47* | 0.54 |
| NEUROD1 | 1.00 | 0.00 | 2.10 | 0.00 | 1.44 | 0.00 | 2.32 | 1.57 | 25.54 | 6.42 |
| OLIG2 | 1.00 | 0.00 | 2.10 | 0.00 | 124181.50* | 14735.13 | 80826.42* | 27820.32 | 36172.45* | 3145.67 |
| PAX6 | 1.11 | 0.48 | 0.06* | 0.00 | 533.31* | 120.59 | 326.02* | 33.14 | 371.42* | 77.50 |
| SYP | 1.02 | 0.25 | 5.22* | 2.10 | 229.40* | 22.54 | 143.94* | 17.41 | 16.48* | 4.47 |
| TH | 1.00 | 0.00 | 9.52 | 14.86 | 1218.08* | 186.74 | 217.79* | 45.71 | 348.31* | 150.50 |

TABLE 8b-continued

Results for Human Stem Cell Pluripotency Array (n = 4 for each sample) - Ectoderm, Endoderm and Mesoderm Markers.

| Gene | Untreated HFF (Passage 8) Rel. Exp. | Std. Dev. | Untransfected HFF (Day 9) Rel. Exp. | Std. Dev. | hNPC neurospheres (Passage 4) Rel. Exp. | Std. Dev. | MSI1/NGN2/MBD2-transfected HFF (Day 9) (NSLC, Passage 1) Rel. Exp. | Std Dev. | Neural stem-like cells, NSLC (Passage 5) Rel. Exp. | Std. Dev. |
|---|---|---|---|---|---|---|---|---|---|---|
| Endoderm markers | | | | | | | | | | |
| AFP | 1.00 | 0.00 | 2.10 | 0.00 | 1.44 | 0.00 | 1.54 | 0.00 | 1.37 | 0.00 |
| FN1 | 1.00 | 0.06 | 1.41 | 0.10 | 0.02* | 0.00 | 1.96 | 0.19 | 0.00* | 0.00 |
| FOXA2 | 1.00 | 0.00 | 150.00* | 55.92 | 1.44 | 0.00 | 1.54 | 0.00 | 1.37 | 0.00 |
| GATA4 | 1.00 | 0.00 | 11.93 | 19.67 | 7.22 | 11.56 | 9.14 | 12.35 | 1.37 | 0.00 |
| GATA6 | 1.00 | 0.09 | 0.37* | 0.17 | 0.00* | 0.00 | 0.44* | 0.04 | 0.02* | 0.01 |
| GCG | 1.00 | 0.00 | 7.96 | 11.74 | 1.44 | 0.00 | 33.59* | 22.17 | 1.37 | 0.00 |
| IAPP | 1.00 | 0.00 | 2.10 | 0.00 | 1.44 | 0.00 | 1.54 | 0.00 | 1.37 | 0.00 |
| INS | 1.00 | 0.00 | 2.10 | 0.00 | 1.44 | 0.00 | 12.67 | 22.26 | 1.37 | 0.00 |
| IPF1 | 1.00 | 0.00 | 2.10 | 0.00 | 1.44 | 0.00 | 1.54 | 0.00 | 1.37 | 0.00 |
| LAMA1 | 1.00 | 0.11 | 4.42* | 0.86 | 78.49* | 6.82 | 43.99* | 2.79 | 46.49* | 16.59 |
| LAMB1 | 1.02 | 0.26 | 12.51* | 2.40 | 0.29* | 0.09 | 2.27* | 0.77 | 3.89* | 1.12 |
| LAMC1 | 1.00 | 0.10 | 2.82* | 0.10 | 1.54 | 0.33 | 3.01* | 0.94 | 1.31 | 0.30 |
| NODAL | 1.00 | 0.00 | 12.16 | 11.62 | 16.27 | 11.25 | 1.54 | 0.00 | 1.37 | 0.00 |
| PAX4 | 1.00 | 0.00 | 6.77 | 9.35 | 1.44 | 0.00 | 1.54 | 0.00 | 1.37 | 0.00 |
| PTF1A | 1.00 | 0.00 | 2.10 | 0.00 | 1.44 | 0.00 | 1.54 | 0.00 | 1.37 | 0.00 |
| SERPINA1 | 1.03 | 0.30 | 0.79 | 0.53 | 0.24 | 0.00 | 1.52 | 1.17 | 0.99 | 0.68 |
| SOX17 | 1.00 | 0.00 | 2.10 | 0.00 | 1.44 | 0.00 | 1.35 | 5.63 | 1.37 | 0.00 |
| SST | 1.25 | 1.00 | 52.58* | 10.67 | 0.55 | 0.36 | 48.97* | 8.70 | 0.92 | 0.42 |
| TAT | 1.00 | 0.00 | 2.10 | 0.00 | 255.86* | 84.52 | 106.04* | 45.87 | 1.37 | 0.00 |
| Mesoderm markers | | | | | | | | | | |
| ACTC | 1.04 | 0.35 | 0.01* | 0.00 | 0.02* | 0.01 | 0.05* | 0.01 | 0.01* | 0.01 |
| CD34 | 1.67 | 1.69 | 501.85* | 61.88 | 45.17* | 27.01 | 113.96* | 39.39 | 13203.40* | 5385.80 |
| CDH5 | 1.00 | 0.00 | 4.12 | 4.06 | 16.69 | 8.07 | 32.41* | 20.31 | 13447.65* | 3220.80 |
| COL1A1 | 1.01 | 0.12 | 2.28* | 0.41 | 0.00* | 0.00 | 0.50* | 0.05 | 0.02* | 0.00 |
| COL2A1 | 3.56 | 6.27 | 103.52* | 37.78 | 1813.86* | 236.76 | 873.19* | 259.80 | 3815.72* | 839.02 |
| DES | 1.00 | 0.07 | 1.94 | 0.33 | 1.09 | 0.33 | 0.87 | 0.07 | 0.22* | 0.08 |
| FLT1 | 1.01 | 0.15 | 0.68 | 0.29 | 0.00 | 0.00 | 0.46* | 0.05 | 0.00* | 0.00 |
| HBB | 3.08 | 4.01 | 0.39 | 0.00 | 0.27 | 0.00 | 0.29 | 0.00 | 0.26 | 0.00 |
| HBZ | 1.14 | 0.63 | 3.53 | 1.32 | 0.25 | 0.22 | 0.61 | 0.63 | 2.88 | 1.20 |
| HLXB9 | 1.00 | 0.00 | 2.10 | 0.00 | 59.80* | 16.35 | 24.94 | 3.14 | 35.12 | 40.50 |
| MYF5 | 1.77 | 1.87 | 0.69 | 0.00 | 0.47 | 0.00 | 0.51 | 0.00 | 0.45 | 0.00 |
| MYOD1 | 1.71 | 2.27 | 1.22 | 0.00 | 0.83 | 0.00 | 0.89 | 0.00 | 0.80 | 0.00 |
| NPPA | 1.00 | 0.00 | 2.10 | 0.00 | 96.60* | 76.23 | 18.97 | 26.98 | 32.37 | 10.96 |
| PECAM1 | 1.00 | 0.00 | 1041.24* | 150.95 | 31.30* | 24.22 | 964.70* | 200.82 | 7305.03* | 1127.69 |
| RUNX2 | 1.01 | 0.12 | 1.76 | 0.37 | 0.09* | 0.02 | 0.78 | 0.23 | 1.18 | 0.27 |
| T | 1.00 | 0.00 | 2.10 | 0.00 | 1.44 | 0.00 | 1.54 | 0.00 | 1.37 | 0.00 |
| WT1 | 2.09 | 3.13 | 1.11 | 0.00 | 0.76 | 0.00 | 2.72 | 3.82 | 4.24 | 4.21 |

For Relative Expression calculations, each sample was normalized to the average Ct of the 6 housekeeping genes (ACTB, 18S, CTNNB1, EEF1A1, GAPD, RAF1), and calibrated to the Untreated HFF (Passage 8) control.

Relative Expression values with asterisk (*) indicate values with significant up or down-regulation (>2-fold or <0.5-fold).

For these samples, for Ct values <35 is considered that the expression of the gene is adequate for quantification.

For the Relative Expression values that are >2-fold or <0.5-fold but without asterisk, the values could have significant error due to the low expression of the gene (Ct > 35), and thus the up or down-regulation could be merely a result of the high standard deviation of the high Ct values of the genes, or fluctuations in the housekeeping genes.

As for the Relative Expression values that are between 0.5-fold and 2-fold, it indicates no significant change in the expression of the gene for these samples.

TABLE 8c

Results for relative expression of Embryonic Stem Cell, Ectoderm, Endoderm/mesoderm, and neuronal markers in untransfected and transfected HFF with Msi1/Ngn2/MBD2 calibrated to untreated HFF (passage 8).

| Gene | Untreated HFF (Passage 8) | | Untransfected HFF (Day 9) | | hNPC neurospheres (Passage 4) | | MSI1/NGN2/MBD2-transfected HFF (Day 9) (NSLC, Passage 1) | | Neural stem-like cells, NSLC (Passage 5) | |
|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. |
| Embryonic Stem Cell Markers | | | | | | | | | | |
| OCT4* | 1.04 | 0.38 | 7.27 | 0.81 | 6.26 | 0.05 | 6.63 | 0.51 | 3.15 | 0.58 |
| OCT4 (5'UTR) | 1.04 | 0.41 | 0.08 | 0.00 | 2.07 | 0.11 | 1.82 | 0.53 | 0.55 | 0.59 |
| NANOG (5'UTR) | 1.02 | 0.32 | 19.29 | 2.23 | 11.27 | 0.89 | 16.73 | 6.86 | 9.94 | 6.32 |
| FBXO15* | 1.05 | 0.46 | 2.58 | 0.45 | 3.57 | 0.23 | 5.89 | 1.22 | 1.13 | 0.39 |
| ALPL* | 1.03 | 0.33 | 0.57 | 0.73 | 652.20 | 46.60 | 194.23 | 10.82 | 13.04 | 4.04 |
| SALL4* | 1.02 | 0.25 | 9.20 | 1.35 | 9.76 | 0.62 | 15.84 | 0.92 | 2.35 | 0.55 |
| NR0B1 (DAX1)* | 1.01 | 0.19 | 18.62 | 4.70 | 2.64 | 0.11 | 11.59 | 3.17 | 0.06 | 0.00 |
| Ectoderm Markers | | | | | | | | | | |
| ZIC1* | 1.01 | 0.24 | 2.01 | 0.25 | 1889.80 | 93.48 | 1158.21 | 80.43 | 156.40 | 12.64 |
| SOX1* | 1.00 | 0.01 | 2.05 | 0.06 | 1776.83 | 128.63 | 1052.75 | 243.07 | 47.98 | 2.12 |
| CDH1 (E-cadherin)* | 1.00 | 0.01 | 2.05 | 0.06 | 264.59 | 6.22 | 59.14 | 7.57 | 18.20 | 3.73 |
| p63 | 1.00 | 0.01 | 68.37 | 72.49 | 18.01 | 5.33 | 39.72 | 12.76 | 37.83 | 6.76 |
| MSX1 | 1.00 | 0.05 | 4.19 | 0.56 | 0.10 | 0.01 | 1.53 | 0.35 | 0.09 | 0.00 |
| NOTCH1* | 1.00 | 0.07 | 1.26 | 0.08 | 7.38 | 1.20 | 4.51 | 0.54 | 4.75 | 0.26 |
| SOX2* | 1.00 | 0.01 | 2.50 | 0.57 | 340909.59 | 5659.15 | 194495.82 | 17929.15 | 219269.76 | 31399.68 |
| SOX2 (3'UTR)* | 1.00 | 0.01 | 7.74 | 8.11 | 864191.09 | 60204.44 | 452684.80 | 26457.70 | 618245.01 | 7107.48 |
| Mesoderm/Endoderm Markers | | | | | | | | | | |
| CXCR4* | 1.05 | 0.46 | 12.45 | 5.64 | 5048.23 | 172.14 | 2763.82 | 30.29 | 3773.11 | 78.89 |
| Neuronal markers | | | | | | | | | | |
| MAP2* | 1.01 | 0.17 | 2.98 | 0.20 | 155.33 | 9.08 | 88.82 | 6.48 | 27.38 | 0.13 |
| TUBB3* | 1.00 | 0.04 | 0.38 | 0.02 | 1.15 | 0.05 | 0.89 | 0.05 | 0.98 | 0.09 |
| ASCL1 (MASH1)* | 1.29 | 1.16 | 11.19 | 0.22 | 42618.46 | 68.52 | 23554.16 | 1588.45 | 31358.79 | 2301.26 |
| NGN2* | 1.00 | 0.01 | 2.05 | 0.06 | 19.45 | 6.64 | 247883.48 | 16409.80 | 968.11 | 191.73 |
| NGN2 (3'UTR)* | 1.83 | 2.17 | 1.17 | 0.76 | 13.39 | 5.10 | 8.45 | 1.75 | 539.02 | 59.72 |
| MSI1* | 1.00 | 0.01 | 263.87 | 70.10 | 100376.36 | 81.45 | 479098.05 | 2281.62 | 116105.29 | 2745.03 |
| MSI1 (3'UTR)* | 1.01 | 0.20 | 13.61 | 2.00 | 3601.96 | 345.79 | 2163.87 | 59.84 | 3698.14 | 160.78 |
| ACHE* | 1.00 | 0.00 | 2.00 | 0.26 | 25.00 | 3.71 | 12.84 | 0.84 | 21.30 | 0.30 |
| Glia markers | | | | | | | | | | |
| CNP* | 1.01 | 0.18 | 1.43 | 0.10 | 3.48 | 0.58 | 2.69 | 0.12 | 1.93 | 0.07 |
| SOX9* | 1.00 | 0.04 | 3.54 | 0.06 | 88.25 | 9.71 | 41.11 | 2.70 | 26.96 | 0.53 |

Genes with asterisk (*) indicate that the Ct values of the test samples are within the quantifiable range (Ct < 35), suggesting the expression of the gene in the test sample is adequate for quantification.
For genes without asterisk, the values may be inaccurate due to the low expression of the gene (Ct > 35) and thus the up or down-regulation is merely a result of the high standard deviation of the high Ct values of the genes, or fluctuation of the housekeeping genes; the trend for these samples may be correct, but the absolute relative expression values may not.
Expression of NGN3 and LIN28 were also tested but these two genes were not expressed in any of the test samples (data not shown).
RT-PCR revealed a significant increase of ectoderm and neuronal markers.
Note that custom primers (5'UTR) for detecting endogenous gene expression are generally not as sensitive and/or effective as standard primers (from the supplier's (Origene) catalog) that dtect overall gene expression (both endogenous and exogenous) of a particular gene.

In another part of the experiment, another batch of cells that were transfected with Msi1/Ngn2+pCMV6-XL5-MBD2 were plated on Poly-Ornithine (30 min at RT) and Laminin (1 h at RT) coated plates in CDM II medium in 5 different wells. On day 1, medium in two of the wells was switched to the same medium as in condition 1a (Table 7) until day 12. Medium was changed daily until day 12, at which point it was switched to either NS-A Differentiation Medium (StemCell Technologies) or NbActive4 (BrainBits™) medium that were both supplemented with BDNF (20 ng/ml), NT-3 (20 ng/ml), NGF (20 ng/ml), Retinoic acid (5 µM), Noggin (20 ng/ml) and Forskolin (10 µM). These cells showed a typical neural stem-like cell morphology by day 7, and proliferated until day 12. During the exposure to either of the two differentiation media, these NSLC changed to a more neuronal and glial phenotype as shown in the bright field pictures, but only expressed GFAP by Day 17.

For the other three wells, on day 1 medium was switched to either NS-A Differentiation Medium (StemCell Technologies), NbActive4 (BrainBits), or CDM II medium; these first two were supplemented with the same cytokines as previously described but with the addition of Fgf-2 (20 ng/ml). On day 12, Fgf-2 was removed from the first two differentiation media while cells in the CDM II medium were switched to the NS-A Differentiation Medium (StemCell Technologies) supplemented with cytokines without Fgf-2. Between day 12 and day 17, media was changed every two to three days. During the first 12 days of culture, cells in all 3 media developed into a mix of more spindle shaped cells compared to untransfected fibroblasts and some into cells with a NSLC morphology; upon removal of Fgf-2 cell morphology turned into a very pronounced neuronal shape as well as glial cells with a network established between cells as shown in the bright field pictures that expressed GFAP and βIII-tubulin by Day 17.

An additional study was designed to assess the effect of Msi1, Ngn2 and MBD2 on their endogenous proteins levels in reprogrammed cells. Cells were transfected with the MSI1/NGN2 vector and MBD2 as previously described and cultured in proliferation condition at 37° C., 5% $CO_2$ and 5% $O_2$. Samples were collected at various time points from Day 2-10 and analyzed by RT-PCR to investigate the expression of endogenous genes and the expression of neural stem cell and neuronal genes at different time points. RT-PCR revealed a gradual loss of total Msi1, Ngn2 and MBD2 gene expression starting from Day 2 to Day 10, with the increase in MBD2 expression relative to control having been almost completely lost by Day 5. This decrease was associated with a significant activation of endogenous Msi1 and Ngn2 on Day 5, with another jump in endogenous gene expression at Day 9 (Table 9). A significant increase in Sox2 expression was detected at Day 4, and the expression of this ectoderm/neural stem cell/neuronal gene continued to increase with each subsequent timepoint (Table 10). GFAP (a neural stem cell and astrocyte marker) was slightly elevated already from Day 2 onwards, but significantly increased on Day 5 with a large jump in gene expression at Day 7 analysis timepoint and stayed at this expression level for the rest of the study period. Expression of the neural stem cell marker Nestin also started to slowly increase from Day 5 onwards. Expression of the neuronal genes βIII-tubulin (TUBB3) and Map2b were slightly elevated already from Day 2 onwards, but significantly increased on Day 5 onwards. Expression of a marker for acetylcholine receptors (found in neurons), acetylcholine esterase (ACHE), was also slightly elevated from Day 2 onwards, but did not significantly increased until Day 7 onwards. It should be noted that among the neural stem cell markers that were analyzed, the relative expression of Sox2 was highly and early expressed which could then be directly or indirectly interact with the exogenous Msi/Ngn2 and/or other genes in the activation of Nestin, GFAP, and endogenous Msi1 and Ngn2 and other genes that promote the reprogramming and cell fate change, as well as the activation of neuronal genes like βIII-tubulin (TUBB3), Map2b, and ACHE.

TABLE 9

RT-PCR analysis of exogenous and endogenous relative expression of Msi1, Ngn2 and MBD2 from Day 2-10 after transfection of fibroblast cells with pCMV-Msi1-Ngn2(Msi1/Ngn2) and MBD2 and cultured for 10 days in proliferation medium. Cells were collected at different time point to analyse endogenous gene expression.

| | MSI1 | | Endogenous MSI1 | | NGN2 | | Endogenous NGN2 | | MBD2 | | Endogenous MBD2 | |
|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| #1 Day 12 Untransfected HFF | 1.01 | 0.18 | 1.04 | 0.38 | 1.01 | 0.15 | 1.01 | 0.15 | 1.01 | 0.21 | 1.00 | 0.14 |
| #2 Day 12 HFF Msi1/Ngn2 + MBD2 | 1102.17 | 91.80 | 620.56 | 19.49 | 2208.36 | 375.09 | 51.09 | 14.69 | 1.09 | 0.00 | 0.83 | 0.06 |
| #3 Day 18 HFF Msi1/Ngn2 + MBD2 | 1470.36 | 164.35 | 950.07 | 152.50 | 71.57 | 52.59 | 122.66 | 39.63 | 1.21 | 0.02 | 0.73 | 0.08 |
| #4 Untransfected Keratinocytes | 1.49 | N/A | 1.01 | N/A | 1.00 | N/A | 1.00 | N/A | 1.02 | N/A | 1.00 | N/A |
| #5 Day 12 Keratinocytes Msi1/Ngn2 + MBD2 | 4142.78 | 872.87 | 364.20 | 60.90 | 4656.42 | 232.63 | 102.01 | 3.18 | 0.40 | 0.14 | 0.74 | 0.30 |
| #6 Day 18 Keratinocytes Msi1/Ngn2 + MBD2 | 4830.20 | 291.17 | 486.38 | 19.59 | 50.01 | 6.99 | 43.08 | 13.78 | 0.40 | 0.01 | 0.67 | 0.01 |
| #7 Untransfected CD34+ | 1.01 | 0.19 | 1.00 | 0.01 | 1.01 | 0.16 | 1.17 | 0.87 | 1.00 | 0.02 | 1.00 | 0.07 |
| #8 Day 18 CD34+ Msi1/Ngn2 + MBD2 | 3969.52 | 286.36 | 147.99 | 7.08 | 2.03 | 0.55 | 3.72 | 1.23 | 0.43 | 0.06 | 0.90 | 0.18 |
| hNPC (14 Oct. 2009, EXP0067) | 7574.57 | 234.74 | 1141.14 | 49.15 | 8.18 | 5.64 | 6.27 | 5.19 | 0.58 | 0.00 | 2.35 | 0.03 |

TABLE 10

RT-PCR analysis of relative expression of Nestin, Map2b, TUBB3, ACHE, GFAP, and Sox2 from Day 2-10 after transfection of fibroblast cells with pCMV-Msi1-Ngn2 (Msi1/Ngn2) and MBD2 and cultured for 10 days in proliferation medium. Cells were collected at different time point to analyse endogenous gene expression.

| | NES | | MAP2 | | TUBB3 | | ACHE | | GFAP | | SOX2 | |
|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| #1 Untransfected Day 2 | 1.00 | 0.04 | 1.00 | 0.01 | 1.00 | 0.03 | 1.00 | 0.08 | 1.01 | 0.23 | 1.17 | 0.87 |
| #2 Msi1/Ngn2 + MBD2/+Noggin Day 2 | 0.88 | 0.01 | 8.59 | 0.18 | 1.38 | 0.03 | 5.71 | 1.06 | 4.56 | 0.08 | 1.26 | 0.82 |
| #3 Untransfected Day 3 | 1.38 | 0.07 | 0.66 | 0.03 | 0.40 | 0.02 | 1.36 | 0.06 | 1.95 | 0.38 | 2.34 | 2.29 |
| #4 Msi1-Ngn2 + MBD2/+Noggin Day 3 | 1.39 | 0.08 | 4.31 | 0.24 | 0.79 | 0.09 | 6.03 | 0.60 | 4.66 | 0.02 | 0.96 | 0.10 |
| #5 Untransfected Day 4 | 2.43 | 0.23 | 1.78 | 0.11 | 0.44 | 0.01 | 2.70 | 0.02 | 3.76 | 0.86 | 0.93 | 0.01 |
| #6 Msi1/Ngn2 + MBD2/+Noggin Day 4 | 1.91 | 0.06 | 2.81 | 0.20 | 0.64 | 0.02 | 6.76 | 0.64 | 8.67 | 1.06 | 5.37 | 6.06 |
| #7 Untransfected Day 5 | 1.40 | 0.05 | 1.13 | 0.04 | 0.41 | 0.03 | 1.17 | 0.37 | 5.44 | 0.02 | 15.03 | 8.77 |
| #8 Msi1-Ngn2 + MBD2/+Noggin Day 5 | 4.31 | 0.08 | 71.60 | 6.43 | 1.34 | 0.01 | 7.60 | 0.18 | 42.28 | 2.94 | 66377.25 | 4089.77 |

TABLE 10-continued

RT-PCR analysis of relative expression of Nestin, Map2b, TUBB3, ACHE, GFAP, and Sox2 from Day 2-10 after transfection of fibroblast cells with pCMV-Msi1-Ngn2 (Msi1/Ngn2) and MBD2 and cultured for 10 days in proliferation medium. Cells were collected at different time point to analyse endogenous gene expression.

| | NES | | MAP2 | | TUBB3 | | ACHE | | GFAP | | SOX2 | |
|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| #9 Untransfected Day 7 | 2.24 | 0.00 | 4.02 | 0.15 | 1.22 | 0.05 | 1.10 | 0.48 | 7.61 | 1.24 | 1.34 | 0.02 |
| #10 Msi1/Ngn2 + MBD2/+Noggin Day 7 | 3.07 | 0.11 | 48.10 | 2.85 | 2.70 | 0.05 | 13.11 | 1.30 | 3271.10 | 149.81 | 44255.59 | 2004.08 |
| #11 Untransfected Day 9 | 4.37 | 0.23 | 14.55 | 0.96 | 1.75 | 0.14 | 3.35 | 0.36 | 15.95 | 0.23 | 429.09 | 119.98 |
| #12 Msi1-Ngn2 + MBD2/+Noggin Day 9 | 7.97 | 0.16 | 123.55 | 3.27 | 2.79 | 0.12 | 16.59 | 0.03 | 3152.25 | 3.31 | 114149.70 | 3372.20 |
| #13 Untransfected Day 10 | 3.48 | 0.44 | 10.03 | 0.37 | 1.63 | 0.21 | 3.20 | 0.81 | 5.64 | 1.92 | 14.66 | 5.03 |
| #14 Msi1/Ngn2 + MBD2/+Noggin Day 10 | 7.48 | 0.22 | 100.25 | 6.66 | 2.87 | 0.03 | 17.49 | 1.35 | 3374.03 | 22.47 | 101105.49 | 3996.44 |

Example IV

Comparison of the Nucleofector™ II Device and the Nucleofector™ 96-Well Shuttle® Device in the Reprogramming of HFF into NSLC in Adherent and Floating Conditions.

HFF cells were cultured as described in Example I, and transfected using the Nucleofector™ II Device (Lonza) as previously described in Example II or the Nucleofector™ 96-well Shuttle® Device (Lonza). The HFFs were harvested with TrypLE™ (Gibco), and 1×10⁶ cells/transfection with the Nucleofector™ II Device for 10 min at 90 g and 6×10⁵ cells/transfection with the Nucleofector™ 96-well Shuttle® Device for 5 min at 80×g. After centrifugation, the cell pellet was gently resuspended in either 100 µl of Basic Nucleofector™ Solution for the Nucleofector™ II or 20 µl of SE Solution (Cell line kit SE, Lonza) for the Nucleofector™96-well Shuttle®. For the Nucleofector™ II Device, each 100 µl of cell suspension was combined with 2 different mixes of plasmid DNA (sample 1 was mixed with 2 µg of pCMV6-XL5-Msi1 and 2 µg pCMV6-XL5-MBD2, and sample 2 with 2 µg of Msi1/Ngn2 and 2 µg pCMV6-XL5-MBD2). Each cell suspension was transferred into an Amaxa certified cuvette and transfected with the appropriate program (U-023). Right after transfection, 900 µl of warm CDM1 medium was added to each cuvette and the sample was transferred into a culture plate coated with Laminin (Stemgent, 10 µg/ml) at a cell density of 1×10⁵ to 1.5×10⁵ cells per cm² or into non-cell culture treated Petri dishes for neurosphere formation. The cells were incubated at 37° C., 5% $CO_2$ overnight. However for the Nucleofector™96-well Shuttle® Device, the steps described before were similar with the following exceptions: the cell suspension was mixed with 0.6 µg of each DNA of the same 2 DNA mixes, the cell suspension was transferred to a well of a 96-well Nucleoplate™ (Lonza) and transfected with the program FF-130™. After transfection, 80 µl of warm CDM1 medium was added to each well and the samples were left for 10 min in the incubator prior to being transferred into a laminin coated plate or non-cell culture treated Petri dishes at the same cell density as previously mentioned. For both devices, these steps were repeated for each sample that was transfected. Prior to transfection cells were cultured in CDM1 as described in Example I. After 24 hours, the medium was switched to a mix of 75% CDM medium and 25% Proliferation Medium which was supplemented with EGF (20 ng/ml), FGF-2 (20 ng/ml), Noggin (20 ng/ml) and Cytochalasin B (10 µg/ml) and the cells were incubated at 37° C., 5% $CO_2$ and 5% $O_2$. The medium was changed daily with an increased proportion of Neural proliferation medium up to 100% by Day 4 and a decreased proportion of Cytochalasin B that was completely omitted by Day 5. Forskolin (10 µM) was added to the medium from Day 4 onwards. The cells in floating conditions were pelleted by centrifugation and their medium changed daily as described for the adherent condition. Cells were collected at Day 3, 7, and 12 for immunohistochemistry analysis.

Fluorescence images were taken with a Cellomics™ ArrayScan HCS Reader™ microscopy system to determine an estimate of the percentage of cells positive for Sox2, a neural stem cell marker. This analysis revealed that in untransfected controls and at 3 days after transfection, no nuclear Sox2 staining was detectable. However, at Day 7 and Day 12 the percentage of Sox2 positive cells increased progressively under all transfection conditions except the pCMV6-XL5-Musashi and pCMV6-XL5-MBD2 Nucleofector™ II condition. The highest percentage at Day 12 was obtained with Msi1/Ngn2 and pCMV6-XL5-MBD2 transfected with the Nucleofector™ 96-well Shuttle® Device (~80%). The same combination transfected with the Nucleofector™ II yielded only ~35% positive cells. The pCMV6-XL5-Musashi and pCMV6-XL5-MBD2 with the Shuttle® produced ~20% positive cells, while generally none were observed with the Nucleofector™ II. The percentage of positive cells varied strongly between wells. The staining indicated that the cell population was not homogenous, since fields of densely arranged Sox2 positive cells and complete fields with only negative cells could be found in all cases. In general the Shuttle® was initially more toxic to cells than the Nucleofector™ II, however at least in the case of Msi1/Ngn2 and pCMV6-XL5-MBD2 shuttle, the Sox2 positive population rapidly expanded from Day 7 to Day 12 to have twice as many Sox2 positive cells as compared to the Nucleofector™ II. The cells in floating conditions did not form spheres during the 12 day experiment in any of the conditions, suggesting that the formation of neurospheres requires either the generation of neural stem-like cells in adherent conditions first or more time.

Table 11 shows the percentage of Sox2 positive cells with a typical neural stem cell morphology using both the Nucleofector™ II Device and the Nucleofector™ 96-well Shuttle® Device. The latter had the advantages of requiring a smaller starting material (less cells and less DNA required) and in addition gave rise to a higher number of Sox2 positive cells. Moreover a very small population of Sox2 positive cells was observed with the Shuttle® Device only upon transfection with only one neurogenic transcription factor (Msi) in the presence of the DNA demethylator MBD2.

TABLE 11

Percentage of positive cells for Sox2 after transfection of fibroblast cells with different expression vectors. After transfection the cells were cultured in proliferation medium (StemCell Technologies) supplemented by EGF (20 ng/ml, Peprotech) and FGF (20 ng/ml, Peprotech) for two weeks at 37° C./5% $CO_2$/5% $O_2$. The percentage of immunopositive cells was determined by Cellomics™ and represented as mean ± SD (n = 3-5).

% Sox2 positive cells

|  |  | Day 3 | | Day 7 | | Day 12 | |
| --- | --- | --- | --- | --- | --- | --- | --- |
|  |  | Sox2 | Total Cell count | Sox2 | Total Cell count | Sox2 | Total Cell count |
| Shuttle | MSI1/NGN2 + MBD2 | 1.34 ± 0.10 | 6430 ± 566 | 31 ± 20 ± 8.03 | 10683 ± 1112 | 78.17 ± 3.10 | 29341 ± 2527 |
|  | Msi + MBD2 | 1.08 ± 0.61 | 8253 ± 399 | 3.19 ± 3.57 | 8953 ± 672 | 19.05 ± 17.88 | 11082 ± 2999 |
| Nucleofector™ | MSI1/NGN2 + MBD2 | 0.87 ± 0.30 | 21870 ± 4476 | 14.30 ± 1.83 | 37321 ± 6877 | 35.93 ± 7.10 | 33009 ± 1567 |
|  | Msi + MBD2 | 0.64 ± 0.07 | 46793 ± 8808 | 0.35 ± 0.16 | 34854 ± 2186 | 0.51 ± 0.25 | 32095 ± 3236 |

Example V

Neurosphere Formation Assay and Cell Differentiation Analysis

Based on previous studies showing that greater proportional reprogramming is achieved by transfecting two neurogenic genes, this study was designed to evaluate the number of reprogramming cells by using the vector Msi1/Ngn2, containing two neurogenic transcription factors (Msi1 and Ngn2) and the role of DNA demethylator or DNA methylation inhibitor (5-azacytidine) and histone deacetylation inhibitor (VPA) in the reprogramming process.

HFFs were cultured and treated with cytochalasin B as described in Example III, and treated simultaneously with VPA (1 mM) and 5-Azacytidine (0.5 µM). After two days of treatment, cells were transfected by Nucleofection as described in Example II with the constructed vector Msi1/Ngn2. After preparing the cells, they were mixed with 2 µg of total DNA (Msi1/Ngn2) and cells that had not been treated with chemical inhibitors (VPA and 5-Aza) were co-transfect with MBD2 (21 µg), using the appropriate program (U023). The samples were transferred into a coated culture plate with Laminin (10 µg/ml, Sigma) and incubated in a humidified 37° C./5% $O_2$/5% $CO_2$ incubator. The medium was changed to the proliferation basal media, Neural Proliferation Medium (NeuroCult™ proliferation Kit, StemCell Technologies), with the presence of Noggin (20 ng/ml, Peprotech), recombinant hFGF (20 ng/ml, Peprotech), and recombinant hEGF (20 ng/ml, Peprotech). Following 6 days of transfection, cells were harvested using Accutase™ (Millipore), centrifuged (300×g, 5 min, RT) and plated in uncoated cell culture dishes in NeuroCult™ NSC Proliferation medium to investigate the capacity to grow cells in suspension as neurospheres or on Laminin coated-plates for adherent culture. To prevent loss of floating spheres during media changes, cells were sedimented by centrifugation at 150×g for 3 min at room temperature (RT). The pellet was then resuspended in fresh medium and plated into new uncoated, low-bind cell culture dishes. Cultures were incubated at 37° C., 5% $CO_2$, 5% $O_2$ and were fed daily for at least two months.

To investigate whether a single cell from human neural precursor cells (hNPCs) and human NSLCs was able to generate a neurosphere (a standard test for proving that a cell is a neural stem cell), neurospheres were dissociated into single cells and these single cells were isolated and cultured in proliferation medium in suspension, and neurosphere formation was monitored by taking bright field images using light microscopy (Nikon, 10×) and by Cellomics™. These cells started to proliferate and grew as spheres starting day 6 to day 10. Immunohistochemistry analysis of these spheres on Day 20, revealed immunopositive staining for the neural stem cells markers Sox2, Museshi, CD133, Nestin, and GFAP. Cells also stained positive for ßIII-tubulin (a marker for neurons), O4 (a marker for oligodendrocytes), and GFAP (a marker for astrocytes), indicating the tri-potent differentiation potential of both sets of cells (NSLC and hNPC), and negative for NGFrec and NeuN (markers for differentiated neurons) indicating that the cells were not terminally differentiated.

TABLE 12

Percentage of positive cells for neural stem cells, and neuronal, astrocyte and oligodendrocyte lineage markers in neurospheres formed from single NSLCs and hNPCs cultured in proliferation medium (StemCell Technologies) supplemented by EGF (20 ng/ml, Peprotech) and FGF (20 ng/ml, Peprotech) for 20 days at 37° C./5% $CO_2$/5% $O_2$. The percentage of positive cells was determined by Cellomics™ and represented as mean ± SD.

| % of positive cells | NSLCs | hNPCs |
| --- | --- | --- |
| Musashi | 91.8 ± 6.8 | 88.6 ± 7.9 |
| Nestin | 78.6 ± 5.7 | 75.4 ± 12.0 |
| GFAP | 69.2 ± 7.4 | 78.6 ± 8.4 |
| βIII-tubulin | 85.6 ± 6.4 | 76.6 ± 8.4 |
| P75 | 0 | 0 |
| NeuN | 0 | 0 |
| O4 | 65.4 ± 6.6 | 71.4 ± 7.5 |
| CD133 | 0 | 0 |

HFF cells were cultured as described in Example I, and transfected using the Nucleofector™ II device (Lonza) as described in Example II. Cells were co-transfected with pCMV6-XL5-Msi/pCMV6-XL4-Ngn2, pCMV-Msi1-Ngn2 with MBD2 or pre-treated with VPA/5aza. Cells were cultured in proliferation medium as suspension or adherent cultures. Gene expression analysis on 8 samples was performed as previously described in Example I with the customized Neuronal Markers 2 TLDA (Table 13) which profiled the expression of 48 genes (including three housekeeping genes: ACTIN, GAPDH and PPIA) in four major categories; 1) fibroblast specific genes; 2) neuronal lineage specific genes; 3) Neural stem cell marker specific genes; and 4) Genes for growth factors and their receptors.

TABLE 13

Neuronal Markers 2 TLDA Layout (Applied Biosystems)
Neuronal Markers 2 TLDA Layout (Applied Biosystems)
Gene Symbols

|    | 1 | 2 | 3 | 4 | 5 | 6 | 7 | 8 |
|----|---|---|---|---|---|---|---|---|
| 1  | ACTB | PPIA | COL3A1 | LOX | S100A4 | SYT1 | SNAP25 | NEUROD1 |
| 2  | VIM | SOX3 | SOX9 | PROM1 | SOX1 | SOX2 | KLF4 | POU5F1 |
| 3  | ACTB | PPIA | COL3A1 | LOX | S100A4 | SYT1 | SNAP25 | NEUROD1 |
| 4  | VIM | SOX3 | SOX9 | PROM1 | SOX1 | SOX2 | KLF4 | POU5F1 |
| 5  | ACTB | PPIA | COL3A1 | LOX | S100A4 | SYT1 | SNAP25 | NEUROD1 |
| 6  | VIM | SOX3 | SOX9 | PROM1 | SOX1 | SOX2 | KLF4 | POU5F1 |
| 7  | ACTB | PPIA | COL3A1 | LOX | S100A4 | SYT1 | SNAP25 | NEUROD1 |
| 8  | VIM | SOX3 | SOX9 | PROM1 | SOX1 | SOX2 | KLF4 | POU5F1 |
| 9  | ACTB | PPIA | COL3A1 | LOX | S100A4 | SYT1 | SNAP25 | NEUROD1 |
| 10 | VIM | SOX3 | SOX9 | PROM1 | SOX1 | SOX2 | KLF4 | POU5F1 |
| 11 | ACTB | PPIA | COL3A1 | LOX | S100A4 | SYT1 | SNAP25 | NEUROD1 |
| 12 | VIM | SOX3 | SOX9 | PROM1 | SOX1 | SOX2 | KLF4 | POU5F1 |
| 13 | ACTB | PPIA | COL3A1 | LOX | S100A4 | SYT1 | SNAP25 | NEUROD1 |
| 14 | VIM | SOX3 | SOX9 | PROM1 | SOX1 | SOX2 | KLF4 | POU5F1 |
| 15 | ACTB | PPIA | COL3A1 | LOX | S100A4 | SYT1 | SNAP25 | NEUROD1 |
| 16 | VIM | SOX3 | SOX9 | PROM1 | SOX1 | SOX2 | KLF4 | POU5F1 |

|    | 9 | 10 | 11 | 12 | 13 | 14 | 15 | 16 |
|----|---|----|----|----|----|----|----|----|
| 1  | MBP | NKX2-2 | GAPDH | OLIG2 | ALDHIL1 | DIO2 | GFAP | NCAM1 |
| 2  | STAT3 | PIK3CG | GDNF | NGF | BDNF | CNTFZFP91-CNTF | GAP43 | NRG1 |
| 3  | MBP | NKX2-2 | GAPDH | OLIG2 | ALDHIL1 | DIO2 | GFAP | NCAM1 |
| 4  | STAT3 | PIK3CG | GDNF | NGF | BDNF | CNTFZFP91-CNTF | GAP43 | NRG1 |
| 5  | MBP | NKX2-2 | GAPDH | OLIG2 | ALDHIL1 | DIO2 | GFAP | NCAM1 |
| 6  | STAT3 | PIK3CG | GDNF | NGF | BDNF | CNTFZFP91-CNTF | GAP43 | NRG1 |
| 7  | MBP | NKX2-2 | GAPDH | OLIG2 | ALDHIL1 | DIO2 | GFAP | NCAM1 |
| 8  | STAT3 | PIK3CG | GDNF | NGF | BDNF | CNTFZFP91-CNTF | GAP43 | NRG1 |
| 9  | MBP | NKX2-2 | GAPDH | OLIG2 | ALDHIL1 | DIO2 | GFAP | NCAM1 |
| 10 | STAT3 | PIK3CG | GDNF | NGF | BDNF | CNTFZFP91-CNTF | GAP43 | NRG1 |
| 11 | MBP | NKX2-2 | GAPDH | OLIG2 | ALDHIL1 | DIO2 | GFAP | NCAM1 |
| 12 | STAT3 | PIK3CG | GDNF | NGF | BDNF | CNTFZFP91-CNTF | GAP43 | NRG1 |
| 13 | MBP | NKX2-2 | GAPDH | OLIG2 | ALDHIL1 | DIO2 | GFAP | NCAM1 |
| 14 | STAT3 | PIK3CG | GDNF | NGF | BDNF | CNTFZFP91-CNTF | GAP43 | NRG1 |
| 15 | MBP | NKX2-2 | GAPDH | OLIG2 | ALDHIL1 | DIO2 | GFAP | NCAM1 |
| 16 | STAT3 | PIK3CG | GDNF | NGF | BDNF | CNTFZFP91-CNTF | GAP43 | NRG1 |

|    | 17 | 18 | 19 | 20 | 21 | 22 | 23 | 24 |
|----|----|----|----|----|----|----|----|----|
| 1  | FOXJ1 | PDGFRA | MKI67 | NES | CSPG4 | DLX2 | MSI1 | CROCC |
| 2  | NPY | CSF3 | BMP4 | TGFB1 | VEGFA | NGFR | EGFR | KDR |
| 3  | FOXJ1 | PDGFRA | MKI67 | NES | CSPG4 | DLX2 | MSI1 | CROCC |
| 4  | NPY | CSF3 | BMP4 | TGFB1 | VEGFA | NGFR | EGFR | KDR |
| 5  | FOXJ1 | PDGFRA | MKI67 | NES | CSPG4 | DLX2 | MSI1 | CROCC |
| 6  | NPY | CSF3 | BMP4 | TGFB1 | VEGFA | NGFR | EGFR | KDR |
| 7  | FOXJ1 | PDGFRA | MKI67 | NES | CSPG4 | DLX2 | MSI1 | CROCC |
| 8  | NPY | CSF3 | BMP4 | TGFB1 | VEGFA | NGFR | EGFR | KDR |
| 9  | FOXJ1 | PDGFRA | MKI67 | NES | CSPG4 | DLX2 | MSI1 | CROCC |
| 10 | NPY | CSF3 | BMP4 | TGFB1 | VEGFA | NGFR | EGFR | KDR |
| 11 | FOXJ1 | PDGFRA | MKI67 | NES | CSPG4 | DLX2 | MSI1 | CROCC |
| 12 | NPY | CSF3 | BMP4 | TGFB1 | VEGFA | NGFR | EGFR | KDR |
| 13 | FOXJ1 | PDGFRA | MKI67 | NES | CSPG4 | DLX2 | MSI1 | CROCC |
| 14 | NPY | CSF3 | BMP4 | TGFB1 | VEGFA | NGFR | EGFR | KDR |
| 15 | FOXJ1 | PDGFRA | MKI67 | NES | CSPG4 | DLX2 | MSI1 | CROCC |
| 16 | NPY | CSF3 | BMP4 | TGFB1 | VEGFA | NGFR | EGFR | KDR |

| Sample ID | Sample Name | TLDA Port |
|-----------|-------------|-----------|
| 1 | HFF Ctrl | 1 |
| 2 | ReNcell Undifferentiated Ctrl | 2 |
| 3 | Msi1-Ngn2/MBD2 | 3 |
| 4 | Msi1-Ngn2/MBD2 | 4 |
| 5 | Msi1-Ngn2/VPA + AZA | 5 |
| 6 | Msi1-Ngn2 | 6 |
| 7 | Msi1-Ngn2/MBD2, neurospheres | 7 |
| 8 | Msi1-Ngn2/MBD2, neurospheres | 8 |

As shown in Table 14, fibroblast-specific genes (Col3A1, Lox, S100A4) were down-regulated in reprogrammed cells, indicating the loss of fibroblast-specific genes following transfection (note that not all cells got transfected and reprogrammed, so the presence of fibroblast-specific gene expression in the cultures is mostly from the un-programmed fibroblasts left in the culture). The expression of these genes is observed to Increase when HFFs were transfected in the absence of DNA demethylator or the DNA methylation inhibitor, Indicating that down-regulation of differentiated markers of fibroblast cells requires DNA demethylation. The expression of ectoderm genes such as Msi1, Sox2, and Nestin was remarkably increased following transfection in conjunction with DNA demethylation. The expression of neuronal markers, such as synaptogamin1 (a synaptic vesicle protein) and NeuroD1 was up-regulated in transfected cells with Msi1/Ngn2/MBD2, and slightly increased in transfected cells with Msi1/Ngn2/VNPA and 5-AZA. The selected three markers of oligodendrocytes were detected in the transfected cells with a strong increase of Olig2. Two markers for astrocytes, GFAP and ALDH1L1, were enhanced following transfection. The results support the idea that neurospheres are composed of heterogeneous progenitor subtypes.

Among the neurotrophic factors, expression of CNTF was slightly increased in the reprogrammed cells. The expression of GAP-43 and neuropeptide Y (NPY) were the most annotated genes. GAP-43 has long been acknowledged to play a pivotal role in axonal plasticity and is used as a marker of regenerating neurite outgrowth and synaptogenesis, both in embryonic development and in neuronal regeneration in injured brain and spinal cord. Expression of receptors for growth and neurotrophic factors was increased, such as neurotrophic receptor tyrosine kinase expression.

TABLE 14

Gene array analysis was performed after one month of transfection of human fibroblast cells with Msi1/Ngn2, in the presence MBD2 or VPA and 5-Aza. Cells were cultured on coated culture plates as adherent cells or on untreated culture plates as neurospheres in proliferation medium (StemCell Technologies) supplemented with EGF (20 ng/ml) and FGF (20 ng/ml). Untransfected cells were considered as negative control and ReNcell (Millipore) as positive control.

| | | Relative expression to #1 HFF Ctrl | | | | | | |
|---|---|---|---|---|---|---|---|---|
| Symbol | Common name and description | #2 ReNcell Undiff | #3 Msi1-Ngn2/ MBD2 | #4 Msi1-Ngn2/ MBD2 | #5 Msi1-Ngn2/ VPA + AZA | #6 Msi1-Ngn2 | #7 Msi1-Ngn2/ MBD2, neurospheres | #8 Msi1-Ngn2/ VPA + AZA, neurospheres |
| Fibroblast/ ECM component | | | | | | | | |
| COL3A1 | Collagen, type III, alpha 1, fibroblast marker | 0.00 | 0.03 | 0.02 | 0.02 | 11.92 | 0.00 | 0.00 |
| LOX | Lysyl oxidase, ECM component | 0.01 | 0.03 | 0.01 | 0.01 | 2.38 | 0.00 | 0.00 |
| FSP1 | Fibroblast transcription site-1, enzyme for ECM remodeling | 0.04 | 0.04 | 0.06 | 0.05 | 3.22 | 0.05 | 0.05 |
| Neuron markers | | | | | | | | |
| SYT1 | Synaptotagmin1, a synaptic vesicle protein in neurons | 106.49 | 108.40 | 78.66 | 26.72 | 22.42 | 37.61 | 16.80 |
| SNAP25 | SNAP25, mature neuron marker | 4.72 | 6.10 | 7.89 | 3.11 | 3.19 | 6.47 | 4.00 |
| NEUROD1* | Neurogenic differentiation 1, neuron marker | 2.32 | 93.35 | 100.84 | 2.02 | 3.11 | 271.11 | 10.23 |
| Oligodendrocyte markers | | | | | | | | |
| MBP* | Myelin Basic Protein, mature oligodendrocyte marker | 2.32 | 48.53 | 18.11 | 6.94 | 667.56 | 16.67 | 1.67 |
| NKX2-2* | NK2 homeobox 2, remyelination | 2.32 | 75.31 | 54.65 | 1.66 | 3.11 | 1.67 | 1.74 |
| OLIG2* | Oligodendrocyte lineage transcription factor 2, oligodendrocyte progenitor | 2856.4 | 15594 | 67369 | 38733 | 3.11 | 92420 | 101733 |
| Astrocyte markers | | | | | | | | |
| ALDH1L1* | Aldehyde dehydrogenase 1 family member L1, astrocyte | 6.20 | 3.77 | 4.65 | 1.66 | 0.02 | 5.87 | 9.59 |
| DIO2* | Deiodinase iodothyronine type II, astrocyte marker | 23.20 | 0.00 | 0.00 | 0.00 | 0.51 | 0.00 | 0.00 |
| GFAP | Glial fibrillary acidic protein, astrocyte marker | 3342.1 | 6899.0 | 6291.0 | 4800.9 | 1.27 | 3118.7 | 3222.0 |

TABLE 14-continued

Gene array analysis was performed after one month of transfection of human fibroblast cells with Msi1/Ngn2, in the presence MBD2 or VPA and 5-Aza. Cells were cultured on coated culture plates as adherent cells or on untreated culture plates as neurospheres in proliferation medium (StemCell Technologies) supplemented with EGF (20 ng/ml) and FGF (20 ng/ml). Untransfected cells were considered as negative control and ReNcell (Millipore) as positive control.

| | | Relative expression to #1 HFF Ctrl | | | | | | |
|---|---|---|---|---|---|---|---|---|
| Symbol | Common name and description | #2 ReNcell Undiff | #3 Msi1-Ngn2/ MBD2 | #4 Msi1-Ngn2/ MBD2 | #5 Msi1-Ngn2/ VPA + AZA | #6 Msi1-Ngn2 | #7 Msi1-Ngn2/ MBD2, neurospheres | #8 Msi1-Ngn2/ VPA + AZA, neurospheres |
| NSCS markers | | | | | | | | |
| NCAM1 | NCAM1, neuroblast marker | 23.21 | 43.90 | 24.45 | 12.72 | 1.13 | 31.93 | 36.70 |
| PDGFRA | Plate-derived growth factor receptor alpha, oligodendrocyte progenitor cells | 0.05 | 0.01 | 0.01 | 0.00 | 4.42 | 0.00 | 0.01 |
| NES | Nestin, neural progenitor | 5.76 | 19.84 | 19.56 | 3.46 | 4.23 | 16.57 | 8.36 |
| MSI1*, ** | Musashi I, neuroblast marker | 5120.3 | 5985.2 | 5262.7 | 5645.1 | 204.34 | 3179.6 | 4113.6 |
| SOX1* | Sox1, neural progenitor | 679.21 | 223.59 | 373.14 | 361.67 | 3.11 | 287.82 | 323.23 |
| SOX2* | Sox2, NSCs | 1924084 | 2265299 | 1889166 | 1014816 | 3.11 | 1313765 | 1103212 |
| Neuro-trophic/ Growth Factor | | | | | | | | |
| GDNF* | Glial cell derived neurotrophic factor | 0.01 | 0.02 | 0.02 | 0.00 | 1.69 | 0.00 | 0.00 |
| NGF* | Nerve growth factor | 0.00 | 0.00 | 0.00 | 0.00 | 1.48 | 0.00 | 0.00 |
| BDNF | Brain derived neurotrophic factor | 0.03 | 0.09 | 0.09 | 0.05 | 0.82 | 0.02 | 0.01 |
| CNTF* | Ciliary neurotrophic factor | 9.25 | 4.32 | 3.11 | 2.90 | 64.05 | 2.31 | 3.39 |
| GAP43 | Growth associated protein 43, neural regeneration | 917.52 | 3506.5 | 1530.8 | 452.75 | 584.00 | 746.25 | 578.52 |
| NRG1* | Neuregulin 1, neural regeneration | 0.01 | 0.00 | 0.00 | 0.00 | 0.40 | 0.00 | 0.00 |
| NPY* | Neuropeptide Y, interneuron | 2.32 | 675.69 | 465.04 | 153.54 | 3.11 | 1244.0 | 130.38 |
| CSF3* | Colony stimulating factor 3, neural regeneration | 0.50 | 0.03 | 0.02 | 0.58 | 18.62 | 0.02 | 0.02 |
| BMP4 | Bone morphogenetic protein 4, remyelination marker | 0.83 | 0.26 | 0.74 | 0.45 | 11.03 | 0.09 | 0.07 |
| TGFB1 | Transforming growth factor, beta 1 | 0.85 | 2.39 | 0.92 | 0.83 | 0.65 | 0.45 | 0.58 |
| Angiogenesis | | | | | | | | |
| VEGFA | Vascular endothelial growth factor | 2.77 | 14.93 | 15.01 | 2.67 | 3.82 | 2.80 | 3.21 |
| Neurotrophin/ Growth Factor Receptors | | | | | | | | |
| NGFR/P75 | NGFR, neurotrophin receptor | 5.35 | 3.29 | 5.78 | 9.10 | 7.53 | 7.26 | 17.51 |
| EGFR | Epidermal growth factor receptor | 0.89 | 0.77 | 0.86 | 0.79 | 1.63 | 1.44 | 1.25 |
| KDR* | Kinase insert domain receptor, growth factor receptor | 210.87 | 259.42 | 263.45 | 51.85 | 0.07 | 11.23 | 17.50 |

Further analysis and quantification of the adherent population of NSLCs showed that cells were positively stained for Sox2 (93.43±1.9%), nestin (60.76±5.7%), and GABA (37.48±4.9), while these markers were undetectable in untransfected cells. Furthermore, these cells stained positive for p75NTR (31.15±1.6), βIII-tubulin (37.55±0.6%) and GFAP (16.47±0.9). However, untransfected HFFs only stained positive for HFF markers, such as fibronectin and fibroblast protein marker, while these markers were undetectable in reprogrammed cells, demonstrating that the reprogrammed cells lost markers of the original cells and adopted morphology and markers of neural stem cells and a neuronal lineage.

TABLE 15

The percentage of cells stained positive for neural stem cell markers and fibroblast markers in untransfected cells and transfected cells with pMsi1/Ngn2/MBD2. Transfected cells (NSLCs) possess a high percentage of neural stem markers but a very low percentage of fibroblast markers as compared to untransfected cells. The percentage of immunopositive cells was determined by Cellomics ™ and represented as mean ± SD (n = 5).

| Marker protein | Transfected fibroblast cells (% of average positive cells ± stdv) | Untransfected fibroblast cells (% of average positive cells ± stdv) |
|---|---|---|
| Sox2 | 93.43 ± 1.9 | 1.90 ± 0.5 |
| Nestin | 60.76 ± 5.7 | 0.84 ± 0.2 |
| p75NTR | 31.15 ± 1.6 | 3.95 ± 1.7 |
| NCAM | 26.84 ± 3.8 | 0.87 ± 0.2 |
| S100 | 41.80 ± 0.6 | 1.60 ± 0.3 |
| GFAP | 16.47 ± 0.9 | 3.84 ± 0.9 |
| βIII-Tubulin | 37.55 ± 0.6 | 1.90 ± 0.9 |
| GABA | 37.48 ± 4.9 | 2.54 ± 0.5 |
| Fibronectin | 1.05 ± 0.7 | 94.19 ± 0.9 |
| Fibroblast marker protein | 4.81 ± 1.0 | 50.30 ± 7.8 |

This study showed as well that NSLCs have the capacity to proliferate in culture and exhibit stable morphology, gene and protein expression that were maintained for the entire study period, which was for over five month in culture (Table 16).

TABLE 16

Doubling time of NSLCs over serial passages. NSLCs were maintained in proliferation conditions for 35 passages in a 37° C., 5%$CO_2$ and 5%$O_2$ incubator. The time required for the cell population to double (g) was calculated for each passage, and was defined as g = (ln2)/k, where k was the number of generations that occured per unit time (t) defined as, k = (ln $N_f$ − ln $N_0$)/t, where $N_f$ was the final cell number and $N_0$ the initial seeded cell number. The average generation time was 25.4 h over 35 passages.

| Passage number | Time (h) | LN $N_0$ | LN $N_f$ | k (h$^{-1}$) | g (h) |
|---|---|---|---|---|---|
| 2 | 168 | 11.513 | 15.577 | 0.024 | 38.655 |
| 3 | 216 | 11.513 | 16.195 | 0.022 | 31.977 |
| 4 | 192 | 11.513 | 18.258 | 0.035 | 39.730 |
| 5 | 144 | 11.513 | 16.258 | 0.033 | 21.036 |
| 6 | 144 | 11.513 | 16.258 | 0.033 | 21.036 |
| 7 | 144 | 11.513 | 15.702 | 0.029 | 33.824 |
| 8 | 168 | 11.513 | 15.870 | 0.026 | 26.729 |
| 9 | 120 | 11.513 | 16.811 | 0.031 | 32.548 |
| 10 | 144 | 11.513 | 15.415 | 0.027 | 35.580 |
| 11 | 120 | 13.122 | 15.895 | 0.023 | 30 |
| 12 | 120 | 11.513 | 15.747 | 0.035 | 19.645 |
| 13 | 168 | 11.513 | 15.870 | 0.026 | 26.729 |
| 14 | 168 | 12.429 | 15.870 | 0.020 | 23.847 |
| 15 | 168 | 11.513 | 15.520 | 0.024 | 29.059 |
| 16 | 192 | 11.513 | 16.167 | 0.024 | 28.596 |
| 17 | 144 | 11.513 | 15.239 | 0.026 | 36.791 |
| 18 | 168 | 11.513 | 15.790 | 0.025 | 37.229 |
| 19 | 120 | 13.122 | 15.870 | 0.023 | 30.276 |
| 20 | 144 | 13.122 | 16.249 | 0.022 | 31.922 |
| 21 | 96 | 13.122 | 15.761 | 0.027 | 25.214 |
| 22 | 120 | 13.122 | 15.870 | 0.023 | 30.276 |
| 23 | 120 | 13.122 | 15.761 | 0.022 | 31.518 |
| 24 | 96 | 13.122 | 15.687 | 0.027 | 25.943 |
| 25 | 96 | 13.122 | 16.013 | 0.030 | 23.022 |
| 26 | 96 | 13.122 | 16.067 | 0.031 | 22.599 |
| 27 | 96 | 13.122 | 16.300 | 0.033 | 20.938 |
| 28 | 120 | 13.122 | 16.482 | 0.028 | 24.752 |
| 29 | 96 | 13.122 | 16.380 | 0.034 | 20.424 |
| 30 | 96 | 13.122 | 16.300 | 0.033 | 19.938 |
| 31 | 120 | 13.122 | 16.483 | 0.028 | 22.752 |
| 32 | 96 | 13.122 | 16.062 | 0.031 | 20.640 |
| 33 | 96 | 13.122 | 16.300 | 0.033 | 20.938 |
| 34 | 96 | 13.122 | 16.077 | 0.031 | 15.519 |
| 35 | 96 | 13.122 | 16.077 | 0.031 | 15.519 |

Gene Expression Microarray

Microarray expression analysis was performed to get a global overview to compare the gene expression profile of passage 7 NSLC to both HFF (the cells that the NSLC were created from) and hNPCs. NSLC (n=3), HFF (n=2), and hNPC (n=3) were resuspended in RNAlater™ (Qiagen) and shipped to Genotypics (India) where the samples were processed and the Gene Expression Microarray was performed.

In brief, Genotypics extracted RNA from the samples and performed Quality Control using an Agilent Bioanalyzer™. Labelling was done using Agilent's Quick Amp™ kit (cDNA synthesis and in vitro transcription), followed by Labelling QC. Hybridization was then performed using the 8×60K array, and scanning was done using high throughput Agilent scanner with SureScan™ technology. The Agilent Feature Extraction software was used for automated feature extraction, followed by Raw Data QC and Image QC. Advanced Data Analysis was then performed, including Pathway and Gene Ontology analysis using Agilent's GeneSpring GX™ v10.0 and Genotypic's Biointerpreter Software. The NSLC samples were compared to the HFF samples (Set 1) and hNPC samples (Set 2) The NSLC samples had a global gene expression pattern that was much closer to the hNPCs than the HFFs from which the NSLCs were created. Pearson correlation analysis revealed that NSLCs are closely related to hNPCs, including in terms of neuronal lineage markers, regenerative genes and migration genes. These data confirm that NSLCs are similar, but not identical, to hNPCs.

Microarray analysis revealed an up-regulation of neural precursor genes in the NSLC samples as compared to the HFF samples. ACTL6A and PHF10, which both belong to the neural progenitors-specific chromatin remodelling complex (npbaf complex) and are required for the proliferation of neural progenitors, were up-regulated by 2.9-fold and 2.3 fold respectively. MSI2, which plays a role in the proliferation and maintenance of stem cells in the central nervous system, was up-regulated by 6-fold (Table X1). Glia genes were up-regulated in the NSLC samples as compared to the HFF samples. GFAP, is a neural stem cell- and astrocyte-specific marker that, during the development of the central nervous system, distinguishes astrocytes from other glial cells, is highly up-regulated in the NSLC sample as compared to HFF (690-fold). OLIG1, which promotes formation and maturation of oligodendrocytes, especially within the brain, is also highly up-regulated in NSLC sample as compared to HFF (370-fold) (Table X2).

Table X3 lists a subset of regenerative genes that are up-regulated in the NSLC samples as compared to the HFF samples. SOX2, a gene critical for early embryogenesis and for embryonic stem cell pluripotency as well as neural stem cells, is highly up-regulated in the NSLC samples as compared to the HFF samples (5000-fold). CCND2, which is essential for the control of the cell cycle at the G1/S (start) transition, is also up-regulated in NSLC samples (70-fold as compared to HFF samples). As shown in Table X4, numerous fibroblast genes were down-regulated in the NSLC samples as compared to the HFF samples. This shows that the NSLC lose the expression of numerous fibroblast genes as it gets reprogrammed from HFF to NSLC.

Table X5 show that neural precursor genes were also up-regulated in the NSLC samples as compared to the hNPC samples. BDNF, which promotes the survival and differentiation of selected neuronal populations of the peripheral and central nervous systems during development, is even more highly expressed in NSLC samples than in hNPC samples (34-fold up-regulation). Table X6 shows that a subset of Glia genes are also up-regulated in the NSLC samples as compared to the hNPC samples. GFAP, a neural stem cell- and astrocyte-specific marker that, during the development of the central nervous system, distinguishes astrocytes from other glial cells, is more highly expressed in NSLC samples than hNPC samples (13-fold). PLP1, the major myelin protein of the central nervous system which plays an important role in the formation or maintenance of the multilamellar structure of myelin, is also more highly expressed in NSLC samples than in hNPC samples (20-fold).

Regenerative genes were also up-regulated in the NSLC samples as compared to the hNPC samples (Table XT). BMP2, a neural crest marker, but which Induces growth especially of cartilage and bone formation and BMP4, which in turn induces cartilage and bone formation and acts in mesoderm induction, tooth development, limb formation and fracture repair, but also in neural stem cells, were both more highly expressed in NSLC samples than in hNPC samples (18-fold and 20-fold respectively). GAP43, which is a major component of the motile growth cones that form the tips of elongating axons was more highly expressed in NSLC samples than hNPC samples (4-fold). This suggests the regenerative potential of NSLC. HOXB4, a transcription factor that is involved in development and also in the expansion of neural stem cells as well as hematopoietic stem and progenitor cells in vivo and in vitro making it a potential candidate for therapeutic stem cell expansion, was also more highly expressed in NSLCs than in hNPCs. This data indicates that NSLCs are more 'stem-like' or have more 'stemness' than hNPCs.

TABLE X1

Up-regulated Neural Precursor genes (NSLC vs. HFF)

| GeneSymbol | Accession Number | Fold change of NSLC compared to HFF[1] | p-value |
|---|---|---|---|
| ACTL6A | NM_178042 | 2.90 | 0.000 |
| ADAM9 | NM_001005845 | 2.64 | 0.004 |
| AIFM1 | NM_004208 | 2.45 | 0.000 |
| BCAT1 | NM_005504 | 3.23 | 0.000 |
| BMP2 | NM_001200 | 17.49 | 0.000 |
| DLL1 | NM_005618 | 40.32 | 0.000 |
| EDNRB | NM_003991 | 933.03 | 0.000 |
| ERBB4 | NM_005235 | 53.22 | 0.006 |
| GMNN | NM_015895 | 4.42 | 0.000 |
| HES5 | BC087840 | 102.33 | 0.000 |
| KIF1B | NM_015074 | 9.45 | 0.002 |
| LIMK1 | NM_002314 | 2.44 | 0.002 |
| MAPK8IP1 | NM_005456 | 5.88 | 0.001 |
| MCHR1 | NM_005297 | 68.19 | 0.001 |
| MEF2C | NM_002397 | 2.91 | 0.000 |
| MSI2 | NM_170721 | 6.76 | 0.000 |
| NMB | NM_021077 | 3.65 | 0.000 |
| NOS2A | NM_000625 | 279.45 | 0.000 |
| NOTCH1 | NM_017617 | 6.75 | 0.000 |
| NPAS3 | NM_022123 | 187.85 | 0.000 |
| PHF10 | NM_018288 | 2.28 | 0.001 |
| PHLPP | NM_194449 | 8.84 | 0.000 |
| SMAD1 | NM_005900 | 4.74 | 0.000 |
| SNTG1 | AL161971 | 34.05 | 0.000 |
| SP8 | NM_198956 | 1392.67 | 0.000 |
| STAU2 | AK002152 | 3.35 | 0.000 |
| STIL | NM_003035 | 4.94 | 0.003 |

[1]Fold change represents the up-regulation of the gene in the NSLC samples as compared to the HFF samples. (n = 2 for HFF samples, n = 3 for NSLC samples).

TABLE X2

Up-regulated Glia genes (NSLC vs. HFF)

| GeneSymbol | Accession Number | Fold change of NSLC compared to HFF[1] | p-value |
|---|---|---|---|
| ASTN1 | NM_004319 | 51.44 | 0.000 |
| ATP1B2 | NM_001678 | 186.64 | 0.000 |
| B3GAT1 | NM_018644 | 1784.49 | 0.000 |
| BCL2 | NM_000633 | 2.65 | 0.002 |
| BMP7 | NM_001719 | 41.35 | 0.000 |
| CA14 | NM_012113 | 43.44 | 0.000 |
| CLCN2 | NM_004366 | 4.18 | 0.000 |
| CNDP1 | NM_032649 | 4.39 | 0.010 |
| CP | NM_000096 | 93.08 | 0.002 |
| CXCR4 | NM_001008540 | 4124.29 | 0.000 |
| ERBB4 | NM_005235 | 53.22 | 0.006 |
| FABP7 | NM_001446 | 18702.36 | 0.000 |
| GAB1 | NM_207123 | 2.44 | 0.001 |
| GFAP | NM_002055 | 696.51 | 0.000 |
| GJB2 | NM_004004 | 13.89 | 0.001 |
| ITGB8 | NM_002214 | 8.48 | 0.005 |
| KCNJ10 | NM_002241 | 263.42 | 0.000 |
| LMO3 | NM_018640 | 194.32 | 0.000 |
| MAP6D1 | NM_024871 | 3.99 | 0.000 |
| MAPT | NM_016835 | 2.38 | 0.001 |
| NDE1 | NM_017668 | 2.21 | 0.002 |
| NEFL | NM_006158 | 10.30 | 0.001 |
| NKX6-2 | NM_177400 | 10.83 | 0.026 |
| NOVA2 | NM_002516 | 7.51 | 0.000 |
| NTN1 | NM_004822 | 5.29 | 0.015 |
| NTRK3 | NM_001012338 | 15.32 | 0.000 |
| OLIG1 | NM_138983 | 372.11 | 0.000 |
| OLIG2 | NM_005806 | 163.20 | 0.000 |
| PARD6A | NM_016948 | 4.12 | 0.001 |
| PASK | NM_015148 | 3.89 | 0.001 |
| PAX6 | NM_001604 | 28.53 | 0.001 |
| PDCD11 | ENST00000369797 | 2.23 | 0.001 |
| PDE6B | NM_000283 | 5.55 | 0.001 |
| PER1 | NM_002616 | 2.43 | 0.001 |
| PLP1 | M54927 | 351.09 | 0.000 |
| PTK2 | NM_153831 | 4.22 | 0.000 |
| QKI | NM_206855 | 8.75 | 0.003 |

TABLE X2-continued

Up-regulated Glia genes (NSLC vs. HFF)

| GeneSymbol | Accession Number | Fold change of NSLC compared to HFF[1] | p-value |
|---|---|---|---|
| S100B | NM_006272 | 456.00 | 0.000 |
| SLC1A3 | NM_004172 | 49.49 | 0.000 |
| SORL1 | NM_003105 | 27.61 | 0.000 |
| SOX9 | NM_000346 | 27.82 | 0.000 |
| SPRY2 | NM_005842 | 15.83 | 0.000 |
| TARDBP | NM_007375 | 2.69 | 0.005 |
| TSPAN12 | NM_012338 | 259.78 | 0.000 |

TABLE X3

Up-regulated Regenerative genes (NSLC vs. HFF)

| GeneSymbol | Accession Number | Fold change of NSLC compared to HFF[1] | p-value |
|---|---|---|---|
| BMP2 | NM_001200 | 17.49 | 0.000 |
| CCND2 | NM_001759 | 72.79 | 0.000 |
| DLL1 | NM_005618 | 40.32 | 0.000 |
| EGR1 | NM_001964 | 2.19 | 0.000 |
| GAL | NM_015973 | 25.93 | 0.000 |
| GAP43 | NM_002045 | 1297.42 | 0.000 |
| HOXB4 | NM_024015 | 102.34 | 0.000 |
| NFE2L2 | AF323119 | 2.80 | 0.004 |
| NOTCH1 | NM_017617 | 6.75 | 0.000 |
| PRPH | NM_006262 | 6.44 | 0.000 |
| SEMA3A | NM_006080 | 3.03 | 0.004 |
| SEMA6A | NM_020796 | 23.58 | 0.000 |
| SOX2 | NM_003106 | 5165.92 | 0.000 |

TABLE X4

Down-regulated Fibroblast genes (NSLC vs. HFF)

| GeneSymbol | Accession Number | Fold change of NSLC compared to HFF[1] | p-value |
|---|---|---|---|
| ACOT2 | NM_006821 | 0.30 | 0.000 |
| AEBP1 | NM_001129 | 0.16 | 0.001 |
| AGA | NM_000027 | 0.35 | 0.000 |
| ANXA2 | NM_001002857 | 0.26 | 0.029 |
| AP4E1 | NM_007347 | 0.30 | 0.008 |
| APOE | NM_000041 | 0.08 | 0.000 |
| ARHGDIB | NM_001175 | 0.24 | 0.009 |
| ASAH1 | NM_004315 | 0.31 | 0.000 |
| BDKRB1 | NM_000710 | 0.00 | 0.001 |
| BDKRB2 | NM_000623 | 0.00 | 0.000 |
| BDNF | NM_170735 | 0.12 | 0.000 |
| BMP4 | NM_001202 | 0.28 | 0.001 |
| C3 | NM_000064 | 0.25 | 0.001 |
| C5orf13 | NM_004772 | 0.18 | 0.000 |
| CACNA1C | NM_000719 | 0.03 | 0.000 |
| CASP4 | NM_033306 | 0.00 | 0.000 |
| CASP5 | NM_004347 | 0.00 | 0.001 |
| CCL2 | NM_002982 | 0.20 | 0.000 |
| CD36 | NM_001001547 | 0.07 | 0.023 |
| CDC42EP2 | NM_006779 | 0.06 | 0.000 |
| CDC42EP3 | NM_006449 | 0.41 | 0.000 |
| CDC42EP5 | NM_145057 | 0.41 | 0.040 |
| CDH11 | NM_001797 | 0.00 | 0.000 |
| CEMP1 | AL833099 | 0.30 | 0.001 |
| CFH | NM_001014975 | 0.01 | 0.010 |
| CITED2 | NM_006079 | 0.14 | 0.000 |
| COL12A1 | NM_004370 | 0.00 | 0.001 |
| COL1A1 | NM_000088 | 0.01 | 0.000 |
| COL1A2 | NM_000089 | 0.00 | 0.001 |
| COL3A1 | NM_000090 | 0.00 | 0.001 |
| COL5A1 | NM_000093 | 0.00 | 0.000 |
| CPT1A | NM_001876 | 0.16 | 0.002 |
| CROT | NM_021151 | 0.27 | 0.002 |
| CTSA | NM_000308 | 0.10 | 0.000 |
| CTSB | NM_147780 | 0.11 | 0.001 |
| CXCL1 | NM_001511 | 0.01 | 0.003 |
| CXCL12 | NM_000609 | 0.00 | 0.001 |
| CYP27A1 | NM_000784 | 0.28 | 0.011 |
| CYR61 | NM_001554 | 0.10 | 0.000 |
| DCHS1 | NM_003737 | 0.29 | 0.000 |
| DMPK | NM_004409 | 0.36 | 0.000 |
| DPT | NM_001937 | 0.05 | 0.006 |
| EFEMP1 | NM_004105 | 0.00 | 0.000 |
| ELN | NM_000501 | 0.13 | 0.001 |
| EMX2 | NM_004098 | 0.00 | 0.001 |
| EPS8 | NM_004447 | 0.18 | 0.000 |
| ETS1 | NM_005238 | 0.15 | 0.003 |
| FAH | NM_000137 | 0.17 | 0.000 |
| FAM14A | NM_032036 | 0.22 | 0.001 |
| FAP | NM_004460 | 0.00 | 0.000 |
| FBLN2 | NM_001004019 | 0.18 | 0.000 |
| FBN1 | NM_000138 | 0.01 | 0.002 |
| FGF1 | NM_000800 | 0.20 | 0.004 |
| FGF13 | NM_004114 | 0.04 | 0.006 |
| FGF2 | NM_002006 | 0.06 | 0.000 |
| FGF5 | NM_004464 | 0.01 | 0.003 |
| FGF7 | NM_002009 | 0.04 | 0.001 |
| FGF9 | NM_002010 | 0.01 | 0.000 |
| FGFR1 | NM_023110 | 0.34 | 0.026 |
| FHL2 | NM_201555 | 0.11 | 0.000 |
| FN1 | NM_212482 | 0.00 | 0.001 |
| FSTL1 | NM_007085 | 0.09 | 0.000 |
| GADD45B | NM_015675 | 0.09 | 0.001 |
| GALNT6 | NM_007210 | 0.13 | 0.001 |
| GAS6 | NM_000820 | 0.02 | 0.000 |
| GBA | NM_001005749 | 0.22 | 0.002 |
| GBAP | NR_002188 | 0.19 | 0.000 |
| GCH1 | NM_000161 | 0.22 | 0.001 |
| GGTA1 | NR_003191 | 0.28 | 0.013 |
| GIT2 | NM_057169 | 0.37 | 0.003 |
| GJA1 | NM_000165 | 0.46 | 0.001 |
| GLIS1 | NM_147193 | 0.02 | 0.000 |
| GM2A | AK127910 | 0.25 | 0.010 |
| GNS | NM_002076 | 0.29 | 0.000 |
| GPC3 | NM_004484 | 0.22 | 0.038 |
| GREM1 | NM_013372 | 0.00 | 0.011 |
| GSTM1 | NM_146421 | 0.27 | 0.001 |
| HAAO | NM_012205 | 0.43 | 0.001 |
| HERPUD1 | NM_014685 | 0.19 | 0.000 |
| HEXA | NM_000520 | 0.24 | 0.000 |
| HEXB | NM_000521 | 0.36 | 0.000 |
| HGF | NM_001010932 | 0.09 | 0.028 |
| HGS | NM_004712 | 0.26 | 0.029 |
| HIF1A | NM_181054 | 0.36 | 0.005 |
| HLA-A | NM_002116 | 0.31 | 0.002 |
| HLA-H | NR_001434 | 0.19 | 0.001 |
| HOXB13 | NM_006361 | 0.03 | 0.004 |
| HR | NM_005144 | 0.18 | 0.002 |
| HSPG2 | NM_005529 | 0.19 | 0.004 |
| IDUA | NM_000203 | 0.16 | 0.000 |
| IGF1 | NM_000618 | 0.10 | 0.004 |
| IGFBP7 | NM_001553 | 0.28 | 0.040 |
| IKBKG | NM_003639 | 0.42 | 0.001 |
| IRF1 | NM_002198 | 0.28 | 0.002 |
| ITGA1 | NM_181501 | 0.00 | 0.001 |
| ITGB3 | NM_000212 | 0.05 | 0.000 |
| KLF4 | NM_004235 | 0.05 | 0.002 |
| LEP | NM_000230 | 0.07 | 0.001 |
| LEPRE1 | NM_022356 | 0.24 | 0.000 |
| LMNA | NM_005572 | 0.42 | 0.000 |
| LOX | NM_002317 | 0.01 | 0.000 |
| LOXL4 | NM_032211 | 0.10 | 0.003 |
| LRRC8C | NM_032270 | 0.15 | 0.013 |
| MAGEL2 | AJ243531 | 0.31 | 0.002 |
| MAN2B1 | NM_000528 | 0.45 | 0.006 |
| MAP3K8 | NM_005204 | 0.27 | 0.001 |
| MEIS2 | NM_170677 | 0.00 | 0.001 |
| MKNK1 | NM_003684 | 0.37 | 0.005 |
| MMP1 | NM_002421 | 0.00 | 0.000 |

TABLE X4-continued

Down-regulated Fibroblast genes (NSLC vs. HFF)

| GeneSymbol | Accession Number | Fold change of NSLC compared to HFF[1] | p-value |
|---|---|---|---|
| MMP14 | NM_004995 | 0.07 | 0.001 |
| MMP2 | NM_004530 | 0.04 | 0.000 |
| MMP3 | NM_002422 | 0.00 | 0.001 |
| MOXD1 | NM_015529 | 0.24 | 0.000 |
| MRAS | NM_012219 | 0.15 | 0.001 |
| MSX2 | NM_002449 | 0.15 | 0.031 |
| MTHFR | NM_005957 | 0.27 | 0.014 |
| MYC | NM_002467 | 0.05 | 0.000 |
| MYL6 | NM_079423 | 0.33 | 0.001 |
| MYL9 | NM_181526 | 0.01 | 0.000 |
| NAGLU | NM_000263 | 0.23 | 0.000 |
| NBL1 | NM_182744 | 0.11 | 0.000 |
| NEK9 | NM_033116 | 0.41 | 0.001 |
| NF2 | NM_181831 | 0.46 | 0.000 |
| NPC1 | NM_000271 | 0.34 | 0.000 |
| OPTN | NM_001008211 | 0.04 | 0.000 |
| P4HB | NM_000918 | 0.37 | 0.001 |
| PALLD | NM_016081 | 0.29 | 0.001 |
| PAPPA | NM_002581 | 0.05 | 0.000 |
| PCDHGB4 | NM_032098 | 0.28 | 0.001 |
| PCK2 | NM_004563 | 0.04 | 0.000 |
| PCOLCE | NM_002593 | 0.00 | 0.000 |
| PDGFRA | NM_006206 | 0.02 | 0.010 |
| PEX14 | BC017848 | 0.48 | 0.000 |
| PFKL | NM_001002021 | 0.35 | 0.004 |
| PPARG | NM_138711 | 0.01 | 0.000 |
| PPFIBP2 | NM_003621 | 0.08 | 0.000 |
| PRR5 | NM_015366 | 0.23 | 0.022 |
| PSEN2 | NM_012486 | 0.34 | 0.002 |
| PTGS1 | NM_000962 | 0.29 | 0.000 |
| PXDN | AF200348 | 0.12 | 0.000 |
| PYCARD | NM_013258 | 0.03 | 0.000 |
| QSOX1 | NM_002826 | 0.09 | 0.000 |
| RASSF1 | NM_170713 | 0.30 | 0.001 |
| RBMS1 | NM_002897 | 0.14 | 0.001 |
| RECK | NM_021111 | 0.07 | 0.000 |
| RET | NM_020975 | 0.35 | 0.015 |
| RFPL1S | NR_002727 | 0.22 | 0.039 |
| ROD1 | NM_005156 | 0.37 | 0.001 |
| RSU1 | NM_012425 | 0.41 | 0.002 |
| S100A4 | NM_002961 | 0.03 | 0.000 |
| SAMD9 | NM_017654 | 0.07 | 0.007 |
| SCARB2 | NM_005506 | 0.42 | 0.001 |
| SDC2 | NM_002998 | 0.38 | 0.000 |
| SDPR | NM_004657 | 0.03 | 0.005 |
| SENP2 | AF151697 | 0.44 | 0.006 |
| SEPP1 | NM_001085486 | 0.00 | 0.005 |
| SFRP1 | NM_003012 | 0.37 | 0.000 |
| SHOC2 | NM_007373 | 0.39 | 0.000 |
| SIGIRR | NM_021805 | 0.47 | 0.000 |
| SLC17A5 | NM_012434 | 0.14 | 0.001 |
| SLC22A5 | NM_003060 | 0.21 | 0.001 |
| SLC9A3R2 | NM_004785 | 0.29 | 0.000 |
| SMPD1 | NM_000543 | 0.17 | 0.000 |
| STAT1 | NM_139266 | 0.19 | 0.000 |
| STAT6 | NM_003153 | 0.00 | 0.000 |
| STS | NM_000351 | 0.10 | 0.007 |
| STYK1 | NM_018423 | 0.05 | 0.013 |
| SUMF1 | NM_182760 | 0.28 | 0.000 |
| TAGLN | NM_001001522 | 0.01 | 0.000 |
| TFAP2A | NM_003220 | 0.03 | 0.005 |
| THBS2 | NM_003247 | 0.02 | 0.000 |
| THRA | NM_199334 | 0.31 | 0.000 |
| THRB | NM_000461 | 0.10 | 0.014 |
| TNXB | NM_019105 | 0.26 | 0.043 |
| TPM2 | NM_213674 | 0.12 | 0.000 |
| TRIOBP | NM_007032 | 0.15 | 0.003 |
| TRIP11 | NM_004239 | 0.45 | 0.001 |
| TSC22D3 | NM_004089 | 0.14 | 0.000 |
| TWIST1 | NM_000474 | 0.01 | 0.003 |
| VCAN | NM_004385 | 0.04 | 0.000 |
| VCL | NM_014000 | 0.28 | 0.000 |
| VLDLR | NM_003383 | 0.15 | 0.000 |
| WISP1 | NM_003882 | 0.05 | 0.013 |
| WNT5A | NM_003392 | 0.01 | 0.000 |
| YAP1 | NM_006106 | 0.41 | 0.007 |
| ZBTB7B | NM_015872 | 0.44 | 0.000 |

TABLE X5

Up-regulated Neural Precursor genes (NSLC vs. hNPC)

| GeneSymbol | Accession Number | Fold change of NSLC compared to hNPC[2] | p-value |
|---|---|---|---|
| ACTL6A | NM_178042 | 2.33 | 0.000 |
| BCAT1 | NM_005504 | 9.92 | 0.000 |
| BDNF | NM_170735 | 33.90 | 0.000 |
| BMP2 | NM_001200 | 17.71 | 0.000 |
| CDKN2A | NM_058197 | 5.57 | 0.000 |
| COL18A1 | NM_030582 | 7.22 | 0.001 |
| DIAPH1 | NM_005219 | 2.33 | 0.001 |
| EDNRB | NM_003991 | 2.78 | 0.000 |
| IDE | NM_004969 | 2.74 | 0.000 |
| LIMK1 | NM_002314 | 3.61 | 0.000 |
| MAPK8IP1 | NM_005456 | 2.77 | 0.000 |
| MCHR1 | NM_005297 | 4.02 | 0.000 |
| MYLIP | NM_013262 | 4.22 | 0.000 |
| NEDD4 | NM_006154 | 2.23 | 0.000 |
| NOS2A | NM_000625 | 267.58 | 0.000 |
| PCSK9 | NM_174936 | 9.65 | 0.000 |
| PSEN2 | NM_000447 | 2.07 | 0.000 |
| SMAD1 | NM_005900 | 3.09 | 0.000 |
| TBX1 | NM_080647 | 3.65 | 0.028 |
| TGFB1 | NM_000660 | 6.66 | 0.000 |

[2]Fold change represents the up-regulation of the gene in the NSLC samples as compared to the hNPC samples. (n = 3 for hNPC samples, n = 3 for NSLC samples).

TABLE X6

Up-regulated Glia genes (NSLC vs. hNPC)

| GeneSymbol | Accession Number | Fold change of NSLC compared to hNPC[1] | p-value |
|---|---|---|---|
| ACSL4 | NM_004458 | 2.10 | 0.000 |
| BDNF | NM_170735 | 33.90 | 0.000 |
| BMP4 | NM_001202 | 20.55 | 0.001 |
| CP | NM_000096 | 159.46 | 0.000 |
| CSPG4 | NM_001897 | 4.94 | 0.000 |
| FOXC1 | NM_001453 | 5.12 | 0.000 |
| GFAP | NM_002055 | 13.67 | 0.000 |
| GJB2 | NM_004004 | 7.25 | 0.000 |
| GLIPR1 | NM_006851 | 5.58 | 0.000 |
| ITGA3 | NM_002204 | 24.64 | 0.000 |
| LMO3 | NM_018640 | 129.25 | 0.000 |
| NEFL | NM_006158 | 7.14 | 0.000 |
| NKX6-2 | NM_177400 | 11.50 | 0.000 |
| NRTN | NM_004558 | 3.39 | 0.001 |
| PDCD11 | NM_014976 | 2.48 | 0.000 |
| PLP1 | NM_000533 | 20.64 | 0.000 |
| TGFB1 | NM_000660 | 6.66 | 0.000 |
| TSPAN12 | NM_012338 | 2.58 | 0.006 |

TABLE X7

Up-regulated Regenerative genes (NSLC vs. hNPC)

| GeneSymbol | Accession Number | Fold change of NSLC compared to hNPC[1] | p-value |
|---|---|---|---|
| ATR | NM_001184 | 2.57 | 0.000 |
| BMP2 | NM_001200 | 17.71 | 0.000 |

TABLE X7-continued

Up-regulated Regenerative genes (NSLC vs. hNPC)

| GeneSymbol | Accession Number | Fold change of NSLC compared to hNPC[1] | p-value |
|---|---|---|---|
| BMP4 | NM_001202 | 20.55 | 0.001 |
| CAV3 | NM_001234 | 26.23 | 0.000 |
| CCND1 | NM_053056 | 10.34 | 0.000 |
| CDKN2A | NM_058197 | 5.57 | 0.000 |

TABLE X7-continued

Up-regulated Regenerative genes (NSLC vs. hNPC)

| GeneSymbol | Accession Number | Fold change of NSLC compared to hNPC[1] | p-value |
|---|---|---|---|
| CEBPB | NM_005194 | 2.58 | 0.000 |
| GAL | NM_015973 | 12.21 | 0.000 |
| GAP43 | NM_002045 | 4.27 | 0.000 |
| HOXB4 | NM_024015 | 133.37 | 0.000 |
| SMAD3 | NM_005902 | 2.27 | 0.000 |

In order to investigate the differentiation potential of NSLCs to neuronal lineages (Neurons, astrocytes, and oligodendocytes), neurospheres were dissociated and plated in laminin/poly-D-Lysine (10 μg/ml; Sigma) in differentiation medium for two weeks. The differentiation towards neuronal lineage was performed using two different mediums: NbActive medium (BrainBits™) supplemented with Brain Derived Neurotrophin Factor (BDNF, 20 ng/ml, Peprotech), all-trans-retinoic acid (ATRA, 5 μM, Spectrum), and bFGF (40 ng/ml, Peprotech) or NeuroCult™ differentiation medium (NeuroCult™ Differentiation kit, StemCell Technologies), supplemented with BDNF (20 ng/ml, Peprotech) and bFGF (40 ng/ml, Peprotech). After two weeks in culture, the cells were stained with the neuronal marker βIII-tubulin, astrocyte markers GFAP and S100β, andoligodendrocyte marker CNPase. The cells were fixed with 4% formaldehyde and the primary antibodies were added in 5% normal goat serum/PBS as follows: Mouse antibody βIII-tubulin (1:200, Abcam), rabbit antibody S100β (1:100, Abcam), and Chicken antibody CNPase (1:50, Abcam). Secondary antibodies are added in 5% normal goat serum/PBS as follows: Goat anti mouse Alexa546™ (1:200, Invitrogen), Goat anti rabbit Alexa488™ (1:200, Invitrogen), and Goat anti-chicken cy5 (1:100, Jackson ImmunoResearch Labs).

Immunohistochemistry analysis showed that NbActive medium promoted the differentiation equally to neuronal (48.66±14.07%, βIII-tubulin) and potential early oligodendrocyte lineages (50.01±4.04%, CNPase) and to a lower percentage of astrocyte cells (2.68±1.13%, S100β), while NS-A differentiation medium induced the differentiation mainly to neurons (64.89±4.11%, βIII-tubulin) and astrocytes (35.94±4.04%, S100beta), and a low percentage of potential early oligodendrocytes cells (8.68±2.71%, CNPase). The NSC-A medium was selected over NbActive for further differentiation studies. Differentiation of cells in NS-A differentiation medium promote the differentiation of hNPC and NSLC similarly as shown in Table 17 by the decrease of the percentage of sox2, musashi and nestin positive cells. NSLCs were differentiated to neuronal (74.3±0.1, GABA), astrocyte lineage (65.6±0.0, S100beta) and to a lower percentage of oligodendrocyte cells (5.2±0.6, CNPase). The same pattern of tripotent lineage differentiation was observed with hNPCs (Table 17).

TABLE 17

The percentage of cells stained positive for neural stem cell and neuronal lineage markers in transfected and untransfected cells. NSLCs and hNPCs were cultured in NS-A-differentiation medium supplemented with BDNF (20 ng/ml) and FGF (40 ng/ml), cultures were incubated at 37° C., 5% $CO_2$, 5%$O_2$ for three weeks. The percentage of immunopositive cells was determined by Cellomics ™ and represented as mean ± SD (n = 5).

| | | Sox2 | Nestin | Musashi | S100 | O4 | GABA |
|---|---|---|---|---|---|---|---|
| Tripotent medium | hNPC | 73.8 ± 0.5 | 46.1 ± 5.2 | 22.1 ± 7.0 | 20.8 ± 1.3 | 6.4 ± 2.9 | 68.5 ± 1.6 |
| | NSLC | 68.6 ± 3.9 | 41.0 ± 5.4 | 26.7 ± 5.0 | 65.6 ± 0.0 | 8.2 ± 0.6 | 74.3 ± 0.1 |

Several additional antibodies to neuronal antigens were used to characterize, in more detail, the nature of differentiated cells. Antibodies against microtubule-associated protein (MAP2b), NCAM, and synaptophysin were used as recommended by the antibody manufacturer. After three weeks in differentiation medium, there was a differentiation-induced reduction in markers of precursors cells and an increase in mature neuronal markers. The percentage of neural precursor markers such as Sox2 were decreased during differentiation, while p75NTR, βIII-tubulin and GABA were increased with lengthening differentiation time; however, O4 positive cells were very low after 3 weeks of differentiation of hNPCs (6.4±2.9) and NSLCs (8.2±0.6). Synaptophysin, an antibody used to identify functional neuronal cells, was increased following 2 and 3 weeks of differentiation, Indicating maturity of the neuronal cells. GABA and acetylcholine markers were increased following 2 weeks of differentiation and decreased at week 3.

The morphological changes and expression of a number of neuronal antigens and genes show that the above method results in normal and viable neuronal cells. Additionally, the newly formed neuronal cells have the morphological criteria of neurons. In addition to the above markers, the differentiated cells were evaluated by characterizing morphological markers of neurite differentiation. Neuron type cells (cells strongly expressing βIII-tubulin) showed neurite formation after differentiation, including an increase in the average number of neurites per neuron (from e.g. 1.38±0.1) The same pattern was observed in βIII-tubulin positive cells. Accordingly, the average neurite length (118.3±3.5 μm) and the number of branch points (3.28±0.3) per neuron also increased. The differentiated neuron-like cells developed long neurites that were greater than three cell diameters in length with a growth cone at the end, expressed neuron-specific genes, and stopped proliferating after the induction of differentiation.

Further differentiation was performed using an optimised medium that promoted the differentiation towards oligodendrocyte lineage. NSLCs and hNPCs were cultured in NS-A differentiation medium as described previously supplemented with FGF-2 (10 ng/ml, Peprotech) and sonic hedgehog (SHH, 100 ng/ml, Peprotech) for 4 days. After 4 days medium was changed to NS-A differentiation medium supplemented by T3 (60 ng/ml, Peprotech), IGF1 (10 ng/ml, Peprotech), NT-3 (10 ng/ml, Peprotech), and PDGF (10 ng/ml, Peprotech). Cells were cultured for 20 days at 37° C., 5% $CO_2$.

TABLE 18

The percentage of cells stained positive for neural stem cell and neuronal lineage markers in transfected and untransfected cells. NSLCs and hNPCs were cultured in differentiation medium supplemented with SHH (100 ng/ml, Peprotech), T3 (60 ng/ml, Peprotech), IGF1 (10 ng/ml, Peprotech), NT-3 (10 ng/ml, Peprotech), and PDGF (10 ng/ml, Peprotech) to induce differentiation towards oligodendrocytes. The percentage of immunopositive cells was determined by Cellomics ™ and represented as mean ± SD (n = 5).

| % of positive cells | Sox2 | Nestin | Musashi | S100 | O4 | GABA |
|---|---|---|---|---|---|---|
| hNPC | 84.3 ± 3.7 | 26.9 ± 4.4 | 51.8 ± 2.9 | 33.4 ± 1.9 | 40.1 ± 6.4 | 89.6 ± 0.8 |
| NSLC | 69.3 ± 4.4 | 24.3 ± 2.5 | 45.1 ± 11.1 | 51.6 ± 9.5 | 8.5 ± 0.6 | 76.9 ± 1.4 |

Quantification of the differentiation of hNPCs and NSLCs revealed a population of cells that were positively stained for 04. As shown in Table 18, the percentage of 04 positive cells was more pronounced in differentiated hNPC (40.1±6.4%) as compared to differentiated NSLCs (8.5±0.6%) when using the above differentiation protocol.

This study showed that transfecting the cells with one or two neurogenic transcription factors in the presence of a DNA demethylator or small molecules for epigenetic modification achieves stable reprogrammed cells (NSLCs). Like a DNA demethylator, epigenetic modification (Inhibition of acetylation and methylation) are sometimes useful in boosting the reprogramming process. These cells possess and retain neural stem cell properties as determined by: (1) the expression of neural stem cell genes and proteins, (2) the capacity to generate and grow as neurospheres starting from a single cell, and (3) to differentiate to neuronal lineages in differentiation conditions. When differentiated to neurons, cells display one or more neural-specific morphological, physiological and/or immunological features associated with a neuronal cell type. Useful criteria include morphological features (long processes or neurites), physiological, and/or immunological features such as expression of a set of neuronal-specific markers or antigens. Furthermore, NSLCs readily turn into a tripotent-like precursor cell with differentiation potential to a high percentage of neuronal, astrocytes and lower percentage of oligodendrocyte populations.

Example VI

Implication of BMP signaling pathway in the Reprogramming of HFFs

This study was designed to evaluate the role of Noggin in the process of de-differentiation of HFFs towards NSLCs.

HFFs were cultured and treated with cytochalasin B as described in Example II. After two days of treatment, calls were transfected by Nucleofection as described in Example II with the constructed vector Msi1/Ngn2. Briefly, after preparing the cells, they were mixed with 2 µg of total DNA (Msi1/Ngn2) and were co-transfect with MBD2 (2 µg), by the Amaxa's Nucleofector™ according to the manufacturer's protocol. The samples were then transferred into a Laminin (10 µg/ml, Sigma) coated culture plate and cultured in the presence of Neural Proliferation Medium (NeuroCult™ proliferation Kit, StemCell Technologies) with recombinant hFGF (20 ng/ml, Peprotech), recombinant hEGF (20 ng/ml, Peprotech), and with or without the presence of Noggin (20 ng/ml, Peprotech). Samples were collected at different time points (1, 3, 4, 6, and 8 days) to analyze neuronal gene expression by RT-PCR and protein expression levels by immunohistochemistry.

Fluorescent immunohistochemical staining was performed on samples after 4 days of transfection as previously described in Example I. Transfected cells were stained and analyzed for expression of Sox2, the percentage of Sox2 was 33.3±1.00% in the presence of Noggin compared to 27.5±0.50% without the presence of noggin at day 4. RT-PCR analysis of relative expression of neuronal precursor cell markers such as nestin and Sox2 after transfection of HFFs with pCMV-Msi1-2A-Ngn2 and pCMV6-XL5-MBD2 with or without the presence of Noggin (20 ng/ml) was associated with an increase in nestin and Sox2 starting at day 3 and maintained until day 8 (Table 19). No difference in the expression was noticed in the absence of Noggin. Inhibiting the BMP signaling pathway by Noggin thus enhanced reprogramming, but had no reprogramming effect on its own.

TABLE 19

RT-PCR analysis of relative expression of neuronal precursor cell markers such as nestin and Sox2 after transfection of HFF with pCMV-Msi1-2A-Ngn2 and pCMV6-XL5-MBD2 with or without Noggin (20 ng/ml). Relative expression of Sox2, and nestin was increased after transfection with and without Noggin.

| | ACHE | | GFAP | | NES | | SOX2 | | TUBB3 | |
|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. |
| #1 Msi1/Ngn2 + MBD2/+Noggin Day 1 | 7.08 | 1.70 | 2.97 | 0.42 | 1.33 | 0.10 | 0.93 | 0.91 | 1.37 | 0.10 |
| #2 Msi1/Ngn2 + MBD2/+Noggin Day 2 | 7.34 | 1.03 | 2.01 | 0.08 | 1.28 | 0.18 | 0.60 | 0.10 | 0.98 | 0.05 |
| #3 Msi1/Ngn2 + MBD2/+Noggin Day 3 | 9.67 | 2.41 | 15.13 | 1.66 | 1.98 | 0.20 | 6333.63 | 277.87 | 0.95 | 0.07 |

TABLE 19-continued

RT-PCR analysis of relative expression of neuronal precursor cell markers
such as nestin and Sox2 after transfection of HFF with pCMV-Msi1-2A-Ngn2 and
pCMV6-XL5-MBD2 with or without Noggin (20 ng/ml). Relative expression of Sox2,
and nestin was increased after transfection with and without Noggin.

| | ACHE | | GFAP | | NES | | SOX2 | | TUBB3 | |
|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. |
| #4 Msi1/Ngn2 + MBD2/+Noggin Day 4 | 11.68 | 2.65 | 194.07 | 25.22 | 4.19 | 0.52 | 20231.33 | 1034.29 | 1.90 | 0.45 |
| #5 Msi1/Ngn2 + MBD2/+Noggin Day 6 | 3.58 | 0.66 | 227.99 | 16.83 | 1.68 | 0.09 | 6298.51 | 289.84 | 0.96 | 0.17 |
| #6 Msi1/Ngn2 + MBD2/+Noggin Day 8 | 10.89 | 0.57 | 650.34 | 22.92 | 4.42 | 0.03 | 18134.90 | 63.93 | 1.81 | 0.06 |
| #7 Ctrl Untransfected + Noggin Day 1 | 1.01 | 0.19 | 1.00 | 0.05 | 1.00 | 0.02 | 1.12 | 0.70 | 1.00 | 0.09 |
| #8 Msi1/Ngn2 + MBD2/−Noggin Day 1 | 2.79 | 0.83 | 1.62 | 0.19 | 0.99 | 0.08 | 1.28 | 0.25 | 0.75 | 0.01 |
| #9 Msi1/Ngn2 + MBD2/−Noggin Day 2 | 3.79 | 0.91 | 1.47 | 0.08 | 1.23 | 0.08 | 1.36 | 0.08 | 0.72 | 0.07 |
| #10 Msi1/Ngn2 + MBD2/−Noggin Day 3 | 6.18 | 0.59 | 14.60 | 1.85 | 2.62 | 0.30 | 10949.28 | 448.28 | 0.90 | 0.01 |
| #11 Msi1/Ngn2 + MBD2/−Noggin Day 4 | 5.63 | 0.74 | 74.56 | 16.56 | 2.97 | 0.21 | 19623.99 | 3109.69 | 0.75 | 0.11 |
| #12 Msi1/Ngn2 + MBD2/−Noggin Day 6 | 3.21 | 0.96 | 232.42 | 5.47 | 1.47 | 0.07 | 15311.64 | 1909.23 | 0.86 | 0.03 |
| #13 Msi1/Ngn2 + MBD2/−Noggin Day 8 | 3.82 | 0.52 | 496.99 | 75.81 | 3.32 | 0.32 | 26892.31 | 1817.05 | 2.05 | 0.10 |
| #14 Ctrl Untransfected − Noggin Day 1 | 1.08 | 0.57 | 1.01 | 0.14 | 1.00 | 0.04 | 1.15 | 0.81 | 1.00 | 0.00 |

Example VII

NSLCs created from HFF cells are not Skin-Derived Precursors (SKPs)

It's known that cells termed skin-derived precursors (SKPs) may reside in adult human skin (Fernandes et al., 2004). These cells are capable of proliferating in response to EGF and bFGF and express nestin, versican and fibronectin, and can differentiate into both neuronal and mesodermal progeny. In order to verify that NSLCs are distinct from SKPs, differentiation towards adipocyte cells was performed. Adipose derived stem cells (ADSC) were maintained in StemPro™ MSC serum free medium (Invitrogen) on flasks coated with CellStart™ (Invitrogen). CellStart™ was diluted 1:100 in dPBS/$Ca^{2+}$/$Mg^{2+}$ and the flask incubated for 2 hours at 37° C. Cells are passaged every 3 to 4 days using Accutase™ and medium was changed every 2 days. Three to four days before initiating differentiation, ADSCs and NSLCs were seeded in 6-wellplates in CellStart™ (1:100 in dPBS/$Ca^{2+}$/$Mg^{2+}$/2 hours at 37° C.) coated tissue culture plates. When cells reached confluence (after 3 to 4 days), proliferation media were replaced by differentiation medium consisting in DMEM/F12 (50:50), ITS (1:100), HEPES (1:100), GlutaMAX™ (1:100), T3 (0.2 nM), Rosiglitasone (0.5 µg/ml), IBMX (100 µM) and Dexamethasone (1 µM). Three days after, IBMX and dexamethasone were withdrawn from the differentiation medium. At day 10, cells were fixed with a 4% formaldehyde solution for 10 min and stained with Oil Red O (Invitrogen) staining solution for 15 min. Staining was removed and cells washed twice with PBS. Adipose cells appeared red with lipid droplets specifically stained with Oil Red O, however NSLCs were stained negative, with no presence of lipid droplets in the cells, and the cells adopted neuronal cell morphology.

Immunohistochemistry analysis confirmed that NSLCs are distinct from SKPs: NSLCs stained positive for p75NTR and negative for fibronectin and versican, while SKPs express fibronectin and versican and do not express p75NTR (Fernandes et al., 2004). This study indicates that NSLCs represent a tripotent-like precursor cell and they are not a subpopulation of SKPs.

Example VIII

BDNF Release from Neural-Like Cells (NLCs)

Neural Stem-Like Cells (NSLCs) differentiated into neuronal and glial cells were kept in culture for 55 days, and BDNF released in the conditioned medium was measured by antigen-capture ELISA at different time points and compared to the release in mature neurons (ScienCell), undifferentiated Neural Human Normal Precursor cells (NHNP, Lonza) as well as to undifferentiated NSLCs and untransfected cells (HFF). Conditioned medium from each group was collected, centrifuged, and then stored at −80° C. until assaying. BDNF concentrations were measured by ELISA kits (BDNF E$_{max}$ Immunoassay System, Promega Corporation, USA), according to the manufacturer's instructions. Briefly, 96-well ELISA immunoplates were coated with Anti-BDNF (CatNb #G700B) diluted 1/1000 in carbonate buffer (pH 9.7) and incubated at 4° C. overnight. The following day, all wells were washed with TBS-Tween™ 0.5% before incubation with Block/Sample buffer 1× at room temperature for one hour without shaking. After blocking, standards and samples were added to the plates and incubated and shaken (450±100 rpm) for 2 h at room temperature. Subsequently, after washing with TBS-Tween™ wash buffer, plates were incubated for 2 h with Anti-Human BDNF pAb (1:500 dilution in Block & Sample 1× Buffer) at 4° C. After incubation, plates were washed five times with TBS-Tween™ 0.5% wash buffer and 100 μl of diluted Anti-IgYHRP Conjugate was added to each well (1:200 dilution in Block & Sample 1× Buffer) and incubated for 1 hour at room temperature with shaking (450±100 rpm). Then, plates were washed five times with TBS-Tween™0.5% wash buffer and 100 μl of TMB One Solution was added to each well. Following 10 minutes incubation at room temperature with shaking (450±100 rpm) for the BDNF plate, a blue color formed in the wells. After stopping the reaction by adding 100 μl of 1N hydrochloric acid, the absorbance was read at 450 nm on a microplate reader (Synergy 4™) within 30 minutes of stopping the reactions. Concentration of released BDNF in the supernatants was determined according to the standard curves.

ELISA results revealed that BDNF was released at the same concentration from differentiated Neuron-Like Cells (NLCs differentiated from NSLCs) and normal Human neuron cells starting at day 11 and remained until day 55 (Table 20), while no BDNF (except for tiny amounts in the untransfected HFF group) was released in the other groups.

TABLE 20

Quantification of BDNF release by Neural-Like Cells (NLCs) that had been differentiated for 55 days from Neural Stem-Like Cells (NSLCs) that had been created from transfected HFFs. BDNF release from NLCs into the medium, at different time points, was measured by antigen-capture ELISA and compared to BDNF release of normal mature human neurons (ScienCell).

| | Control medium | Neurons | NLC |
|---|---|---|---|
| day 0 | | | |
| day 11 | 1.55 | 30.25 | 22.99 |
| day 18 | 0.33 | 29.49 | 25.15 |
| day 24 | 0.33 | 22.01 | 26.39 |
| day 34 | 0.23 | 25.53 | 32.21 |
| day 41 | 0.27 | 19.02 | 22.43 |
| day 55 | 0.02 | 20.73 | 30.01 |

In addition to adopting neuronal morphology criteria, the NLCs were functional and possessed the capacity to release neurotrophic factor (BDNF). Generating reprogrammed neuronal-like cell lines that can locally deliver these neurotrophic factors could be used as a method to treat several neurological conditions and may offer crucial benefits in regeneration and functional recovery from brain and other injuries.

Example IX

Reprogramming of Different Cell Types Towards NSLCs:

This study was performed to investigate the capacity of keratinocytes (Invitrogen), human Adipocytes Derived Stem Cells (ADSCs, Invitrogen) and human hematopoietic stem cells (CD34$^+$, Invitrogen) cells into neural stem-like cells.

Preparation of Human CD34$^+$ Cells, Human ADSC and Human Keratinocytes:

Human mobilized peripheral blood CD34$^+$ cells were purchased from StemCell Technologies and expanded as a floating culture in Petri Dishes in complete StemPro™-34 Serum-free Medium (Invitrogen) supplemented with Stem Cell Factor (SCF, 150 g/ml, Peprotech), Granulocyte Colony-Stimulating Factor (GM-CSF, 37.5 ng/ml, Peprotech) and IL-3 (75 ng/ml, Peprotech). Medium supplemented with cytokines was changed everyday 2-3 days after centrifugation of the cell suspension at 300×g for 10 min. Every other day the cytokines were added directly to the culture without changing the media. Cells were incubated at 37° C., 5% $CO_2$. For their passaging, cells were centrifugated, resuspended in the above medium plus cytokines and placed into the adequate number of Petri dishes.

Human Adipose-Derived Stem Cells (ADSC) were purchased from Invitrogen and expanded in complete StemPro™ MSC Serum-free medium (Invitrogen) on CellStart™ (Invitrogen) coated flasks (diluted 1:100 in PBS containing $Ca^{2+}/Mg^{2+}$) at a cell density of 1×10$^4$ cells/cm$^2$. Medium was replaced every two days with fresh pre-warmed complete StemPro™ MSC SFM. Cells were incubated at 37° C., 5% $CO_2$. Cells were sub-passaged when 80% confluent by incubation for 3-5 min in pre-warmed TrypLE™ (Invitrogen) and then collected in StemPro™ MSC medium. After centrifugation at 1500 rpm for 5 min, cells were seeded on CellStart™ coated flasks as described above.

Primary human keratinocytes were purchased from Invitrogen and expanded in Defined Keratinocyte Serum-free medium on Coating matrix (Invitrogen) coated flasks (Invitrogen) at a cell density of 5×10$^3$ cells/cm$^2$. The cells were incubated at 37° C., 5% $CO_2$. Media was replaced with fresh, complete growth media every two to three days until subculture. Once the cells had reached 70-80% confluency, media was removed and the cells were incubated in Versene™ (Invitrogen) for 3-5 min at room temperature. Versene™ was removed, and pre-warmed 0.05% trypsin-EDTA (Invitrogen) was added to the flasks. After 5-10 min incubation, growth medium containing Soybean Trypsin inhibitor (Invitrogen) was added to the flasks and the cells gently triturated. After centrifugation at 100×g for 10 min, cells were resuspended in the desired volume of pre-warmed, complete growth medium on coated flasks as described above.

Prior to transfection, cells were trypsinized and transiently co-transfected with pCMV-Msi1-Ngn2 and pCMV6-XL5-MBD2 as previously described in Example IV using the Shuttle and plated into a culture plate coated with laminin (Sigma, 10 μg/ml). Starting one day after transfection, cells were treated with VPA (1 mM) for 4 days and the medium was changed gradually to proliferation medium supplemented with FGF (20 ng/ml) and EGF (20 ng/ml) and were cultured for 18 days at 37° C. 5% $CO_2$ and 5% $O_2$.

Cells were then analyzed for neural stem cell markers by RT-PCR and Immunohistochemistry.

Further analysis and quantification of the reprogrammed cells revealed a population of NSLCs engendered from keratinocyte and CD34+ cells. RT-PCR Analysis revealed an increase of relative expression of neural stem cell markers such as Sox2, nestin, GFAP, and βIII-tubulin after transfecting Keratinocyte and CD34+ by Msi1 and Ngn2. Relative expression of nestin and GFAP was enhanced in NSLCs created from keratinocytes and CD34+ cells as compared to NSLCs from HFFs; however, the reverse was true for Sox2 and ACHE expression. βIII-tubulin (TUBB3) and Map2b expression was highest in NSLCs created from CD34+ cells, followed by NSLCs created from HFF (Table 21). This data shows that different types of NSLCs with different gene expression profiles (and characteristics) can be created from different types of starting/source cells (and the same has been observed for creating some other types of stem-like cells discussed in this application). The data is also intriguing since it was not expected that keratinocytes (which are derived from the ectoderm just as endogenous neural stem cells) would have a lower expression than HFFs for all the genes analyzed except for Nestin (it was expected that keratinocytes would be the easiest to reprogram into NSLCs since they are derived from the ectoderm).

TABLE 21

RT-PCR analysis was performed after one month of transfection of human fibroblasts (HFF), Keratinocytes, and CD34+ cells with Msi1/Ngn2 (MSI1/NGN2), in the presence MBD2 with VPA treatment. Cells were cultured on coated culture plates in proliferation medium (StemCell Technologies) supplemented with EGF (20 ng/ml) and FGF (20 ng/ml) for 18 days. Untransfected cells were considered as negative control.

| | NES | | MAP2 | | TUBB3 | | ACHE | | GFAP | | SOX2 | |
|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| #1 Day12 Untransfected HFF | 1.00 | 0.07 | 1.00 | 0.05 | 1.00 | 0.01 | 1.01 | 0.15 | 1.00 | 0.02 | 1.08 | 0.59 |
| #2 Day12 HFF Msi1/Ngn2 + MBD2 | 2.25 | 0.03 | 21.48 | 2.09 | 3.41 | 0.45 | 12.92 | 1.88 | 558.69 | 80.08 | 71513.12 | 14146.80 |
| #3 Day18 HFF Msi1/Ngn2 + MBD2 | 2.56 | 0.15 | 17.12 | 0.14 | 2.65 | 0.02 | 4.13 | 0.64 | 75.96 | 8.82 | 84794.40 | 318.54 |
| #4 Untransfected Keratinocytes | 1.07 | 0.54 | 1.00 | 0.07 | 1.00 | 0.02 | 1.01 | 0.19 | 1.06 | 0.48 | 1.00 | 0.01 |
| #5 Day 12 Keratinocytes Msi1/Ngn2 + MBD2 | 11452.65 | 1137.13 | 0.96 | 0.11 | 6.78 | 0.28 | 1.09 | 0.05 | 5815.54 | 510.91 | 975.81 | 7.47 |
| #6 Day 18 Keratinocytes Msi1/Ngn2 + MBD2 | 12593.79 | 431.06 | 0.93 | 0.04 | 6.41 | 0.27 | 0.48 | 0.03 | 1295.15 | 32.05 | 1047.17 | 139.48 |
| #7 Untransfected CD34+ | 1.00 | 0.04 | 1.01 | 0.16 | 1.00 | 0.00 | 1.00 | 0.01 | 1.10 | 0.66 | 1.01 | 0.21 |
| #8 Day 18 CD34+ Msi1/Ngn2 + MBD2 | 839.57 | 134.51 | 346.61 | 33.97 | 33.91 | 4.38 | 0.28 | 0.00 | 2790.18 | 304.43 | 25080.35 | 35.93 |
| hNPC | 4.56 | 0.07 | 278.36 | 11.50 | 0.81 | 0.06 | 72.65 | 1.83 | 1285.73 | 5.27 | 565552.30 | 41717.72 |

Immunohistochemistry revealed positive staining for GFAP, Sox2, and nestin. NSLCs developed from HFF yield a higher percentage of positive staining for Sox2 and GFAP (55.8±3.8 and 78.1±2.4) as compared to CD34⁺ cells (42.8±2.7 and 24.2±4.4), and keratinocytes (47.1±2.1 and 43.4±8.9). The percentage of nestin positive cells was high in Keratinocytes (77.6±10.7) and HFF (68.45±12.9) and lower in CD34⁺ cells (15.5±2.7) (Table 22). Sox2 and Nestin positive staining was undetectable in ADSCs.

TABLE 22

The percentage of Sox2 and nestin positive cells for neural stem cell markers after transfecting fibroblast, keratinocyte, and CD34⁺ cells with pCMV-Msi1-Ngn2 in the presence of MBD2 and VPA. Cells were cultured on coated culture plates in proliferation medium (StemCell Technologies) supplemented with EGF (20 ng/ml) and FGF (20 ng/ml) for 18 days. Untransfected cells were considered as negative control. The percentage of immunopositive cells was determined by Cellomics ™ and represented as mean ± SD (n = 5).

| % positive cells | Untransfected cells | Fibroblasts | Keratinocytes | CD34+ |
|---|---|---|---|---|
| Sox2 | 1.5 ± 1.7 | 55.8 ± 3.8 | 47.1 ± 2.1 | 42.8 ± 2.7 |
| GFAP | 0.04 +/− 0.2 | 78.1 ± 2.4 | 43.4 ± 8.9 | 24.2 ± 4.4 |
| Nestin | 0.3 +/− 0.3 | 68.45 ± 12.9 | 77.6 ± 10.7 | 15.5 ± 2.7 |

NSLCs generated from keratinocytes and CD34⁺ cells were tested for tripotent capacity. Further differentiation studies were performed to Induce differentiation of these NSLCs towards neuronal lineage, using NeuroCult™ differentiation medium (NeuroCult™ differentiation Kit, StemCell Technologies) supplemented with BDNF (20 ng/ml, Peprotech) and bFGF (40 ng/ml, Peprotech) as described in Example V. NSLCs generated from HFFs and hNPCs were used as controls, cultures were incubated at 37° C., 5% $CO_2$, 5% $O_2$ for three weeks. Samples were collected or fixed at Day 14 and 28 following differentiation for further analysis. RT-PCR analysis revealed decrease of undifferentiated genes (Nestin and Sox2) and increased of differentiated genes (Map2, βIII-tubulin, CNPase, and GFAP) as shown in Tables 23A, 23B, 23C and 23D.

TABLE 23A

RT-PCR analysis was performed on NSLCs generated from human fibroblasts (HFF), keratinocytes, and CD34⁺ cells that were cultured on Poly-D-Lysin/Laminin coated culture plates in differentiation medium for 28 days (StemCell Technologies) supplemented with BDNF (20 ng/ml) and FGF (40 ng/ml). hNPCs (Lonza) were considered as a positive control. hNPCs had a much lower increase in ACHE, GFAP, and MAP2b (which actually decreased in hNPCs), but an increase in Nestin, compared to NSLCs under differentiation conditions.

| | NES | | MAP2 | | TUBB3 | | ACHE | | GFAP | | SOX2 | | SOX9 | | CNP | |
|---|---|---|---|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| hNPC Control | 1.00 | 0.08 | 1.00 | 0.10 | 1.00 | 0.08 | 1.01 | 0.16 | 1.00 | 0.09 | 1.01 | 0.16 | 1.00 | 0.12 | 1.00 | 0.09 |
| Diff. hNPC Day 14 | 3.86 | 0.20 | 0.65 | 0.05 | 4.87 | 0.57 | 0.74 | 0.52 | 97.26 | 7.13 | 1.85 | 0.21 | 0.50 | 0.04 | 1.43 | 0.05 |
| Diff. hNPC Day 28 | 1.86 | 0.06 | 0.68 | 0.02 | 3.67 | 0.13 | 1.33 | 0.09 | 102.74 | 1.89 | 1.29 | 0.01 | 0.73 | 0.05 | 1.37 | 0.02 |
| NSLC Control | 1.00 | 0.04 | 1.00 | 0.04 | 1.00 | 0.04 | 1.00 | 0.03 | 1.00 | 0.01 | 1.00 | 0.01 | 1.00 | 0.02 | 1.00 | 0.05 |
| Diff. NSLC Day 14 | 1.38 | 0.01 | 1.00 | 0.09 | 2.06 | 0.02 | 1.57 | 0.24 | 1.79 | 0.12 | 0.73 | 0.01 | 0.56 | 0.01 | 1.31 | 0.05 |
| Diff. NSLC Day 28 | 0.62 | 0.02 | 0.90 | 0.08 | 5.14 | 0.21 | 6.47 | 0.78 | 5.70 | 0.15 | 1.30 | 0.02 | 0.79 | 0.03 | 1.41 | 0.01 |
| HFF-NS Control | 1.00 | 0.00 | 1.00 | 0.05 | 1.00 | 0.01 | 1.00 | 0.07 | 1.00 | 0.00 | 1.00 | 0.07 | 1.00 | 0.01 | 1.00 | 0.02 |
| Diff. HFF-NS Day 14 | 2.70 | 0.08 | 3.08 | 0.12 | 3.24 | 0.14 | 59.93 | 5.85 | 478.97 | 0.27 | 2.90 | 0.32 | 0.81 | 0.03 | 4.02 | 0.35 |
| Diff. HFF-NS Day 28 | 1.27 | 0.05 | 1.48 | 0.11 | 1.59 | 0.03 | 24.62 | 1.00 | 576.80 | 20.98 | 1.52 | 0.00 | 0.86 | 0.08 | 2.74 | 0.23 |
| Kerat-NS Control | 1.00 | 0.06 | 1.00 | 0.02 | 1.00 | 0.03 | 1.00 | 0.11 | 1.00 | 0.01 | 1.00 | 0.07 | 1.00 | 0.02 | 1.00 | 0.01 |

TABLE 23A-continued

RT-PCR analysis was performed on NSLCs generated from human fibroblasts (HFF), keratinocytes, and CD34+ cells that were cultured on Poly-D-Lysin/Laminin coated culture plates in differentiation medium for 28 days (StemCell Technologies) supplemented with BDNF (20 ng/ml) and FGF (40 ng/ml). hNPCs (Lonza) were considered as a positive control. hNPCs had a much lower increase in ACHE, GFAP, and MAP2b (which actually decreased in hNPCs), but an increase in Nestin, compared to NSLCs under differentiation conditions.

| | NES | | MAP2 | | TUBB3 | | ACHE | | GFAP | | SOX2 | | SOX9 | | CNP | |
|---|---|---|---|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| Diff. Kerat-NS Day 14 | 2.43 | 0.06 | 3.48 | 0.08 | 2.82 | 0.11 | 56.22 | 5.58 | 665.91 | 10.52 | 3.09 | 0.29 | 1.01 | 0.14 | 3.72 | 0.17 |
| Diff. Kerat-NS Day 28 | 0.81 | 0.03 | 1.72 | 0.00 | 1.61 | 0.18 | 26.09 | 1.12 | 673.65 | 11.34 | 1.29 | 0.03 | 1.12 | 0.03 | 2.02 | 0.05 |
| CD34+-NS Control | 1.00 | 0.05 | 1.00 | 0.07 | 1.00 | 0.04 | 1.00 | 0.08 | 1.00 | 0.00 | 1.00 | 0.08 | 1.00 | 0.02 | 1.00 | 0.07 |
| Diff. CD34+-NS Day 14 | 2.21 | 0.04 | 3.47 | 0.07 | 2.75 | 0.04 | 57.87 | 6.68 | 407.54 | 52.07 | 2.90 | 0.18 | 1.10 | 0.05 | 3.54 | 0.02 |
| Diff. CD34+-NS Day 28 | 0.79 | 0.04 | 1.48 | 0.01 | 1.83 | 0.37 | 26.92 | 3.73 | 485.51 | 10.66 | 1.02 | 0.04 | 1.20 | 0.09 | 2.34 | 0.05 |

TABLE 23B

RT-PCR analysis was performed on undifferentiated NSLCs generated from human fibroblasts (HFF), keratinocytes, and CD34+ cells that were cultured on Laminin coated culture plates in Proliferation medium for 4 days (StemCell Technologies) supplemented with EGF (20 ng/ml) and FGF (20 ng/ml). Relative expression calibrated to undifferentiated hNPCs.

| | NES | | MAP2 | | TUBB3 | | ACHE | | GFAP | | SOX2 | | SOX9 | | CNP | |
|---|---|---|---|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| Undifferentiated hNPC Control Day 4 | 1.00 | 0.08 | 1.00 | 0.10 | 1.00 | 0.08 | 1.01 | 0.16 | 1.00 | 0.09 | 1.01 | 0.16 | 1.00 | 0.12 | 1.00 | 0.09 |
| Undifferentiated NSLC Control Day 4 | 1.23 | 0.05 | 0.12 | 0.00 | 1.12 | 0.04 | 0.09 | 0.00 | 21.45 | 0.26 | 0.65 | 0.01 | 0.28 | 0.01 | 0.37 | 0.02 |
| Undifferentiated HFF-NS Control Day 4 | 0.94 | 0.00 | 0.12 | 0.01 | 0.92 | 0.01 | 0.03 | 0.00 | 0.38 | 0.00 | 0.37 | 0.02 | 0.32 | 0.00 | 0.31 | 0.00 |
| Undifferentiated Kerat-NS Control Day 4 | 1.00 | 0.06 | 0.09 | 0.00 | 0.97 | 0.03 | 0.03 | 0.00 | 0.23 | 0.00 | 0.38 | 0.03 | 0.26 | 0.00 | 0.30 | 0.00 |
| Undifferentiated CD34+-NS Control Day 4 | 1.10 | 0.05 | 0.12 | 0.01 | 0.95 | 0.04 | 0.04 | 0.00 | 0.33 | 0.00 | 0.44 | 0.04 | 0.26 | 0.00 | 0.30 | 0.02 |

TABLE 23C

RT-PCR analysis was performed on differentiated NSLCs generated from human fibroblasts (HFF), keratinocytes, and CD34+ cells that were cultured on Poly-D-Lysin/Laminin coated culture plates in differentiation medium for 14 days (StemCell Technologies) supplemented BDNF (20 ng/ml) and FGF (40 ng/ml). Relative expression calibrated to Day 14 differentiated hNPCs.

| | NES | | MAP2 | | TUBB3 | | ACHE | | GFAP | | SOX2 | | SOX9 | | CNP | |
|---|---|---|---|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| Diff. hNPC Day 14 | 1.00 | 0.05 | 1.00 | 0.07 | 1.00 | 0.12 | 1.15 | 0.80 | 1.00 | 0.07 | 1.00 | 0.11 | 1.00 | 0.08 | 1.00 | 0.03 |
| Diff. NSLC Day 14 | 0.44 | 0.00 | 0.18 | 0.02 | 0.47 | 0.00 | 0.22 | 0.03 | 0.40 | 0.03 | 0.26 | 0.00 | 0.31 | 0.00 | 0.34 | 0.01 |
| Diff. HFF-NS Day 14 | 0.66 | 0.02 | 0.56 | 0.02 | 0.62 | 0.03 | 2.96 | 0.29 | 1.86 | 0.00 | 0.58 | 0.06 | 0.52 | 0.02 | 0.87 | 0.08 |
| Diff. Kerat-NS Day 14 | 0.63 | 0.02 | 0.51 | 0.01 | 0.56 | 0.02 | 2.78 | 0.28 | 1.56 | 0.02 | 0.64 | 0.06 | 0.54 | 0.08 | 0.79 | 0.04 |
| Diff. CD34+-NS Day 14 | 0.63 | 0.01 | 0.62 | 0.01 | 0.54 | 0.01 | 3.77 | 0.43 | 1.39 | 0.18 | 0.69 | 0.04 | 0.58 | 0.03 | 0.76 | 0.00 |

TABLE 23D

RT-PCR analysis was performed on differentiated NSLCs generated from human fibroblasts (HFF), keratinocytes, and CD34+ cells that were cultured on Poly D-Lysin/Laminin coated culture plates in differentiation medium for 28 days (StemCell Technologies) supplemented with BDNF (20 ng/ml) and FGF (40 ng/ml). Relative expression calibrated to Day 28 differentiated hNPCs.

|  | NES | | MAP2 | | TUBB3 | | ACHE | | GFAP | | SOX2 | | SOX9 | | CNP | |
| --- | --- | --- | --- | --- | --- | --- | --- | --- | --- | --- | --- | --- | --- | --- | --- | --- |
|  | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| Diff. hNPC Day 28 | 1.00 | 0.03 | 1.00 | 0.02 | 1.00 | 0.04 | 1.00 | 0.07 | 1.00 | 0.02 | 1.00 | 0.01 | 1.00 | 0.07 | 1.00 | 0.02 |
| Diff. NSLC Day 28 | 0.41 | 0.01 | 0.15 | 0.01 | 1.56 | 0.06 | 0.44 | 0.05 | 1.19 | 0.03 | 0.66 | 0.01 | 0.30 | 0.01 | 0.38 | 0.00 |
| Diff. HFF-NS Day 28 | 0.64 | 0.03 | 0.26 | 0.02 | 0.40 | 0.01 | 0.59 | 0.02 | 2.12 | 0.08 | 0.43 | 0.00 | 0.38 | 0.04 | 0.62 | 0.05 |
| Diff. Kerat-NS Day 28 | 0.44 | 0.02 | 0.24 | 0.00 | 0.42 | 0.05 | 0.62 | 0.03 | 1.50 | 0.03 | 0.38 | 0.01 | 0.40 | 0.01 | 0.44 | 0.01 |
| Diff. CD34+-NS Day 28 | 0.47 | 0.03 | 0.25 | 0.00 | 0.47 | 0.10 | 0.85 | 0.12 | 1.57 | 0.03 | 0.35 | 0.01 | 0.43 | 0.03 | 0.52 | 0.01 |

Fluorescent immunohistochemical staining was performed on samples after 14 days and 28 days of differentiation. The expression of Sox2 and Nestin was decreased time dependently in differentiated cells (HFF, keratinocyte, and CD34+). This decrease was associated with an increase of differentiated markers at day 28 such as GFAP (68.51±11.87 for HFF-NC, 59.55±9.12 for Keratinocyte NC, and 61.70±1.48 for CD34+-NC). A high percentage for βIII-tubulin positive cells was generated from differentiated NSLCs generated from HFF (57.83±4.49) as compared to βIII-tubulin positive cells generated from Keratinocytes (23.27±2.91) and CD34+ cells (39.15±7.99) (Table 24)

TABLE 24

The percentage of cells stained positive for neural stem cell markers and neuronal lineage markers in hNPCs (Lonza) and transfected keratinocytes, HFF, and CD34+ cells with pMsi1/Ngn2/MBD2. Transfected cells (NSLCs) were cultured in Proliferation medium or differentiation medium for 28 days at 37° C., 5%$CO_2$, 5%$O_2$. The percentage of immunopositive cells (Sox2, Nestin, GFAP, S100beta, and βIII-tubulin) was determined by Cellomics ™ and represented as mean ± SD (n = 5)

| | % positive cells | Proliferation conditions | 14 days differentiation | 28 days differentiation |
| --- | --- | --- | --- | --- |
| hNPC | Sox2 | 96.23 ± 0.51 | 59.05 ± 3.01 | 41.43 ± 6.05 |
| | Nestin | 41.47 ± 0.23 | 10.77 ± 4.78 | 16.14 ± 7.41 |
| | s100β | 37.38 ± 7.85 | 49.51 ± 2.39 | n.d. |
| | βIII-tubulin | 2.34 ± 0.43 | 11.54 ± 4.03 | 23.34 ± 4.77 |
| | GFAP | 1.16 ± 0.14 | 23.42 ± 2.51 | 48.04 ± 8.30 |
| HFF-NC | Sox2 | 93.28 ± 0.53 | 79.48 ± 0.54 | 52.06 ± 9.07 |
| | Nestin | 29.29 ± 4.72 | 1.15 ± 0.46 | 2.18 ± 1.96 |
| | s100β | 13.51 ± 0.28 | 80.75 ± 3.50 | 79.38 ± 10.62 |
| | βIII-tubulin | 3.91 ± 0.33 | 42.16 ± 15.07 | 57.83 ± 4.49 |
| | GFAP | 8.41 ± 0.73 | 59.66 ± 11.48 | 68.51 ± 11.87 |
| Keratinocyte-NC | Sox2 | 96.55 ± 1.01 | 76.93 ± 5.13 | 63.11 ± 8.54 |
| | Nestin | 40.10 ± 8.41 | 2.67 ± 1.61 | 3.57 ± 0.48 |
| | s100β | 13.58 ± 4.97 | 76.6 ± 9.72 | 74.75 ± 11.21 |
| | βIII-tubulin | 6.42 ± 2.94 | 20.58 ± 8.34 | 23.27 ± 2.91 |
| | GFAP | 9.36 ± 0.34 | 43.43 ± 2.44 | 59.55 ± 9.12 |
| CD34+-NC | Sox2 | 95.49 ± 2.6 | 81.18 ± 1.24 | 63.46 ± 5.14 |
| | Nestin | 51.68 ± 14.27 | 12.64 ± 1.27 | 8.46 ± 4.6 |
| | s100β | 30.1 ± 1.03 | 72.40 ± 4.5 | 79.57 ± 8.52 |
| | βIII-tubulin | 5.82 ± 2.08 | 25.04 ± 19.95 | 39.15 ± 7.99 |
| | GFAP | 13.99 ± 5.48 | 51.79 ± 13.68 | 61.70 ± 1.48 | n.d. = not determined; ± = standard deviation

CD34+-NC: neuronal cells generated after differentiation of NSLCs generated from CD34+ cells. Each data point represents the analysis of at least 1000 cells from at least 8 images.

The % of Sox2 positive cells decreased faster, the % of Nestin positive cells generally decreased slower, and the % of cells expressing one of the differentiation markers (S100β, βIII-tubulin, GFAP) generally increased slower in hNPCs than in the NSLCs during differentiation. Out of the three types of created NSLC lines, the % of cells expressing one of the differentiation markers (S100β, βIII-tubulin, GFAP) generally increased slowest in NSLCs created from keratinocytes and fastest in NSLCs created from HFFs.

This study indicates that NSLCs can be created from keratinocytes and CD34+ blood cells, and these cells share morphology and markers similarly to NSLCs generated from HFF. Similarly to hNPCs, NSLCs created from keratinocytes, CD34+ cells, and HFFs had a tendency to differentiate more towards an astrocyte lineage than a neuronal lineage (except NSLCs created from HFFs had an almost similar number of βIII-tubulin positive and GFAP positive cells) as shown by the high percentage of GFAP positive cells during differentiation, which was confirmed by S100beta staining. However, the proportion of astrocyte and neuronal cells generated from hNPCs was lower in same culture conditions, indicating that NSLCs generated from HFF, Keratinocytes, and CD34+ cells can give rise to a higher number of neuronal and astrocyte cells as compared to hNPCs. NSLCs, whether created from HFFs, Keratinocytes or CD34+ cells (or potentially even some other cell), are tripotent cells and possess the capacity to differentiate to neurons, astrocytes, and oligodendrocytes similarly to hNPCs. However, RT-PCR and immunohistochemistry analysis of transfected ADSCs did not reveal any significant expression of neural stem cell genes, indicating a need to optimize conditions for turning ADSCs to NSLCs or to investigate the effect of others neurogenic factors that could turn these into NSLCs.

Example X

Fabrication 3D Extracellular Matrix (CDM)

Fibroblast cells were cultured in DMEM medium in the presence of 10% FCS as described in Example I, followed by seeding onto 12-well plates pre-coated with laminin (10 μg/ml) at a concentration of 2×10$^6$ cells/ml in defined CDM Medium consisting of a 3:1 ratio of Dulbecco's modified Eagle medium (DMEM, high glucose (4.5 g/L) with L-glutamine and sodium pyruvate) and Ham's F-12 medium supplemented with the following components: EGF (4.2× 10$^{-10}$M), bFGF (2.8×10$^{-10}$M), ITS (8.6×10$^{-5}$M), dexamethasone (1.0×10$^{-7}$M), L-ascorbic acid phosphate magnesium salt n-hydrate (3.2×10$^{-4}$M), L-3,3',5-triiodothyronine (2.0×10$^{-10}$M), ethanolamine (10$^{-4}$M), GlutaMAX™ (4×10$^{-3}$M), glutathione (3.3×10$^{-6}$M), and 1% penicillin/streptomycin/amphotericin B. By culturing the fibroblast cells at hyperconfluent density in this completely chemically defined medium causes them to enter a high synthetic phase with a slow-down in proliferation, leading to the production of a living tissue equivalent (LTE) consisting of multiple layers of fibroblasts within de novo 3D extracellular matrix (CDM) that is completely synthesized by the fibroblasts themselves.

Trans-Differentiation and Reprogramming of Cells within CDM

Day 14 CDM samples were treated with cytochalasin B (10 g/ml, Calbiochem), with the concentration of cytochalsin B reduced from 10 μg/ml to 0 g/ml (none) over 5 days while at the same time switching the medium from CDM Medium to NbActive medium. Samples were cultured for another 12 days at 37° C., 5% CO$_2$, and the medium was changed every day. Samples were fixed to perform immunohistochemistry as described previously to detect Neuronal markers. The following antibodies were used: mouse anti-nestin 647 (1:100, BD) and anti-βIII-tubulin (1:200, Neuromics). No clear morphology change of the cells was observed within the CDM and the immunohistochemical analysis failed to detect βIII-tubulin positive cells. Thus, inducing the trans-differentiation of cells using only cytochalasin B and chemically-defined neural medium was not sufficient to reprogram the cells.

Next, Day 6 CDM samples grown in LAS pre-coated plates at 37° C. and 5% CO$_2$, were exposed simultaneously to cytochalasin B (10 μg/ml) over 5 days, histone deacetylation inhibitor (VPA, 4 mM, Calbiochem) and inhibitor of DNA methylation (5-Azacytidine, 5 μM, Sigma). Four days later, the medium was changed to differentiation medium consisting of a 3:1 ratio of CDM medium without the presence of EGF and NbActive medium (BrainBits™) supplemented with NT-3 (20 ng/ml, Peprotech) and BDNF (20 ng/ml, Peprotech). The ratio of the differentiation medium was increased gradually day after day until reaching 100% of complete differentiation medium. After two weeks of treatment, cells were fixed for immunohistochemical analysis to investigate the identity of the cells. Immunostained cells with βIII-tubulin at day 7, Indicating the de-differentiation of fibroblast cells to neurons. However, one week later, these transdifferentiated cells reverted back to fibroblast cells and βIII-tubulin expression was lost. The loss of morphology and βIII-tubulin expression after withdrawal of the priming agents indicate that complete conversion to functional and stable reprogrammed cells did not occur.

Next CDM was treated with VPA (4 mM), 5-Aza (5 μM) and cytochalasin B (10 μg/ml) as above. After 2 days of chemical treatment, fibroblast cells within the CDM were transfected with DNA using Lipofectamine reagent (Invitrogen) as per the manufacturer's protocol. 15 μg of the eukaryotic DNA expression vectors pCMV6-XL5-Pax6, pCMV6-XL5-Msi1 and pCMV6-XL4-Ngn2 (Origene) were used to transfect the cells. 24 hours later, the media was changed to Neural Progenitor Basal Medium (Lonza) supplemented with Noggin (50 ng/ml), EGF (20 ng/ml), and bFGF (20 ng/ml), and the cells were cultured at 37° C., 5% CO$_2$ and 5% O$_2$, and the medium was changed every day. At day 6, differentiation was initiated by adding gradually NB Active medium (BrainBits™) supplemented with NT-3 (20 ng/ml, Peprotech), all-trans-retinoic acid (ATRA, 5 μM, Spectrum), BDNF (20 ng/ml, Peprotech), and bFGF (40 ng/ml, Peprotech). To characterize the reprogrammed cells, immunohistochemical analysis and RT-PCR was performed at various time points according to the methods described in Example II using primers for nestin, βIII-tubulin, GFAP, MAP2b, and ACHE. In agreement with previous studies, un-transfected cells and cells transfected with Pax6 did not expressed genes specific for neuronal lineages (Table 25). On the other hand, following transfection with Msi1, levels of nestin and ACHE were increased to 4-fold and 8-fold, respectively, and this expression was maintained over the 12-day period. Also levels of GFAP mRNA was enhanced time dependently by approximately 14 times. Likewise, the same pattern was observed in Ngn2 transfected cells. While expression of βIII-tubulin and MAP2b were modestly increased following transfection with one neurogenic transcription factors the regulation of gene expression after transfecting the cells with two neurogenic factors, Msi1 or Ngn2 with Pax6, did not further increase the expression of neuronal genes. Expression of these genes was enhanced when the cells were transfected with Msi1 and Ngn2, with βIII-tubulin enhanced to almost 6-fold at day 12.

TABLE 25

RT-PCR analysis of relative expression of neuronal precursor cell markers such as nestin, βIII-tubulin, MAP2b, ACHE, and GFAP after transfection of fibroblast cells with pCMV6-XL5-Msi1, pCMV6-XL4-Ngn2, pCMV6-XL5-Pax6, and pCMV6-XL5-MBD2. After 24 h following transfection, CDM I Medium was changed and cells were cultured in proliferation medium (NPBM, Lonza) supplemented with EGF (20 ng/ml. Peprotech) and bFGF (20 ng/ml, Peprotech) for one week. Differentiation was induced by changing the medium to NbActive (BrainBits ™) supplemented with NT-3 (20 ng/ml), bFGF (20 ng/ml), ATRA (5 μM) and Forskolin (10 μM). Cells were incubated at 37° C., 5% $CO_2$, 5% $O_2$ for 12 days. Relative expression of Msi1, Ngn2, Pax6, nestin, βIII-tubulin, ACHE, MAP2b and GFAP in NSLCs and NLCs was increased after transfection with both transcription factors Ngn2 and Msi1 with MBD2 as the DNA demethylator.

| | COL5A2 | | FBN2 | | NES | | MAP2 | | TUBB3 | | SOX2 | | ACHE | | GFAP | |
|---|---|---|---|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| #1, +CytoB, Control | 1.00 | 0.07 | 1.00 | 0.01 | 1.00 | 0.04 | 1.00 | 0.05 | 1.00 | 0.05 | 1.00 | 0.05 | 1.00 | 0.10 | 1.00 | 0.11 |
| #2, −CytoB, Control | 1.00 | 0.03 | 1.00 | 0.08 | 1.00 | 0.00 | 1.00 | 0.09 | 1.00 | 0.09 | 1.15 | 0.80 | 1.01 | 0.18 | 1.00 | 0.01 |
| #3, +CytoB, Msi1, GAD45b | 0.85 | 0.04 | 0.75 | 0.02 | 0.60 | 0.01 | 0.29 | 0.01 | 0.44 | 0.00 | 22.39 | 5.26 | 0.81 | 0.19 | 10.14 | 0.15 |
| #4, −CytoB, Msi1, GAD45b | 0.87 | 0.03 | 1.81 | 0.09 | 1.84 | 0.04 | 2.31 | 0.00 | 2.09 | 0.03 | 20.28 | 5.33 | 1.99 | 0.74 | 6.03 | 0.05 |
| #5, +CytoB, Ngn2, GAD45b | 0.84 | 0.04 | 0.77 | 0.03 | 0.44 | 0.00 | 0.24 | 0.00 | 0.36 | 0.01 | 470.84 | 13.43 | 0.63 | 0.05 | 103.22 | 0.80 |
| #6, −CytoB, Ngn2, GAD45b | 0.75 | 0.07 | 1.97 | 0.02 | 1.83 | 0.00 | 4.40 | 0.16 | 2.02 | 0.10 | 789.33 | 60.35 | 1.70 | 0.13 | 110.48 | 4.90 |
| #7, +CytoB, Pax6, GAD45b | 0.74 | 0.12 | 1.08 | 0.00 | 0.89 | 0.01 | 0.51 | 0.00 | 0.63 | 0.04 | 1.64 | 0.98 | 0.86 | 0.12 | 2.49 | 0.21 |
| #8, −CytoB, Pax6, GAD45b | 0.66 | 0.04 | 2.41 | 0.09 | 2.70 | 0.03 | 4.96 | 0.30 | 3.48 | 0.07 | 0.46 | 0.33 | 2.97 | 1.04 | 0.43 | 0.09 |
| #9, +CytoB, Msi1, Ngn2, GAD45b | 0.14 | 0.01 | 0.28 | 0.01 | 1.30 | 0.03 | 4.07 | 0.11 | 0.84 | 0.00 | 54768.27 | 6709.56 | 0.81 | 0.24 | 3391.96 | 64.63 |
| #10, −CytoB, Msi1, Ngn2 GAD45b | 0.12 | 0.00 | 0.73 | 0.03 | 5.28 | 0.21 | 50.84 | 1.23 | 4.93 | 0.28 | 17400.66 | 822.88 | 3.58 | 0.10 | 1255.76 | 5.27 |
| #11, +CytoB, Msi1, Ngn2 MBD2 | 0.10 | 0.00 | 0.26 | 0.01 | 1.11 | 0.01 | 3.69 | 0.09 | 0.76 | 0.00 | 55588.41 | 1331.20 | 0.55 | 0.14 | 2849.96 | 261.51 |
| #12, −CytoB, Msi1, Ngn2 MBD2 | 0.44 | 0.01 | 1.47 | 0.06 | 5.49 | 0.14 | 47.30 | 0.11 | 5.50 | 0.31 | 14587.46 | 789.19 | 3.90 | 0.13 | 1424.04 | 39.29 |
| #13, +CytoB, GAD45b | 1.11 | 0.04 | 1.09 | 0.06 | 0.92 | 0.08 | 0.68 | 0.01 | 0.82 | 0.03 | 63.93 | 2.81 | 1.19 | 0.17 | 17.43 | 1.86 |
| #14, −CytoB, GAD45b | 0.94 | 0.01 | 2.22 | 0.00 | 2.82 | 0.02 | 6.49 | 0.30 | 4.01 | 0.05 | 6.12 | 0.61 | 2.34 | 0.17 | 1.42 | 0.10 |
| #15, +CytoB, MBD2 | 0.83 | 0.00 | 0.83 | 0.05 | 0.36 | 0.01 | 0.16 | 0.01 | 0.36 | 0.00 | 3.42 | 3.74 | 0.63 | 0.37 | 2.18 | 0.12 |
| #16, −CytoB, MBD2 | 0.68 | 0.02 | 1.55 | 0.04 | 1.57 | 0.05 | 1.47 | 0.01 | 2.00 | 0.00 | 0.52 | 0.29 | 1.45 | 0.15 | 0.55 | 0.04 |
| #17, +CytoB, Msi1, Ngn2 | 1.10 | 0.01 | 1.16 | 0.03 | 1.37 | 0.01 | 1.12 | 0.06 | 0.86 | 0.06 | 5.59 | 1.48 | 1.07 | 0.27 | 1.70 | 0.46 |
| #18, −CytoB, Msi1, Ngn2 | 0.93 | 0.04 | 2.52 | 0.10 | 3.48 | 0.01 | 9.01 | 0.02 | 4.55 | 0.18 | 1.78 | 1.46 | 3.83 | 0.42 | 0.59 | 0.01 |
| #19, +CytoB, Msi1, MBD2 | 0.20 | 0.03 | 0.36 | 0.01 | 1.25 | 0.05 | 6.68 | 0.31 | 0.72 | 0.02 | 66592.29 | 3481.89 | 2.57 | 0.03 | 4450.08 | 131.85 |
| #20, −CytoB, Msi1, MBD2 | 0.12 | 0.00 | 0.64 | 0.03 | 4.70 | 0.22 | 77.51 | 0.11 | 4.12 | 0.11 | 19128.03 | 1542.00 | 8.14 | 0.13 | 999.22 | 24.75 |
| #21, +CytoB, Ngn2, MBD2 | 0.17 | 0.01 | 0.28 | 0.00 | 1.16 | 0.04 | 5.73 | 0.06 | 0.62 | 0.00 | 67945.51 | 3000.74 | 2.15 | 0.04 | 4736.83 | 11.92 |
| #22, −CytoB, Ngn2, MBD2 | 0.17 | 0.00 | 0.78 | 0.03 | 4.32 | 0.08 | 68.89 | 5.26 | 4.01 | 0.04 | 16570.91 | 92.96 | 7.04 | 0.53 | 1427.13 | 13.19 |
| #23, +CytoB, Msi1 | 0.71 | 0.05 | 0.79 | 0.06 | 0.87 | 0.01 | 0.63 | 0.06 | 0.67 | 0.04 | 2.86 | 0.70 | 1.08 | 0.08 | 2.08 | 0.11 |
| #24, −CytoB, Msi1 | 0.66 | 0.04 | 1.92 | 0.17 | 2.03 | 0.02 | 2.77 | 0.02 | 2.68 | 0.02 | 0.32 | 0.12 | 1.85 | 0.65 | 0.58 | 0.04 |

Same pattern of gene expression was observed when transfecting the cells with three transcription factors (Msi1, Ngn2, and Pax6), but the expression was less pronounced than in cells transfecting with just Msi1 and Ngn2. In terms of immunohistochemical analysis after the 12 days of the transfection, cells displayed neuronal markers after transfection with Msi1 or Ngn2, as indicated by the expression of nestin and MAP2b. Cells transfected with pCMV-XL-PAx6 did not stain for Nestin and MAP2b.

This study shows that transfecting cells within CDM with only one neurogenic factor (Msi1 or Ngn2) induces morphological changes and expression of one or more markers of neural stem cells and neuronal cells. Since the reprogrammed cells expressed a key neurogenic factor, a neuronal precursor marker, and a mature neuronal marker at low percentage (10%), this suggests that cells within the CDM were transformed to NSLCs and then started to differentiated through the various phases of the neuronal determination and differentiation program induced in neural stem cells.

Example XI

Gene Expression Analysis of Reprogrammed Cells within CDM

This study was designed to test the effect of transfecting cells with Msi1 and Ngn2 in the presence of MBD2 in the reprogramming process. Cells were transfected after two days of pre-treatment with cytochalasin B with the DNA expression vectors using Lipofectamine reagent as described in Example X. 15 µg of eukaryotic DNA expression vectors pCMV6-XL5-Musashi or pCMV6-XL4-Ngn2, and pCMV6-XL5-MBD2 (Origene), were used to co-transfect cells. After 24 hours, the media was changed to CDM: Neural Progenitor Maintenance Medium (1:1) supplemented with Noggin (50 ng/ml), EGF (20 ng/ml), and bFGF (20 ng/ml). Medium was changed every day by increasing the percentage of NPBM and decreasing CDM medium. Cells were cultured for 6 days at 37° C., 5% $CO_2$ and 5% $O_2$. After one week, differentiation was initiated by gradually supplementing the NPBM Medium with NT-3 (20 ng/ml, Peprotech), all-trans-retinoic acid (ATRA, 5 µM, Spectrum), BDNF (20 ng/ml, Peprotech), and bFGF (40 ng/ml, Peprotech). Samples were collected at the end of the study (day 14) and data were analyzed by gene array to identify genes that were reproducibly found to be specific for neuronal lineages.

Gene Expression Analysis

Gene expression analysis on 8 samples was performed as previously described in Example I with the customized Neuronal Markers 2 TLDA In order to identify the expression of genes related to neural stem cells, neuronal cells and glial cells, and growth factors expressed by the cells after transfection. The expression of oligodendrocyte genes, such as NKx2.2, olig2, and MAG was increased by Msi1 and Ngn2; however, the increased was more pronounced by Msi1 as compared to Ngn2 (Table 26). Two markers for astrocytes (GFAP and AQP4) were highly expressed after transfection with Msi1 and Ngn2 in the presence of the DNA demethylator MBD2. Interestingly, several markers of early neuronal cells were enhanced; 12 days after transfection, TDLA data revealed increases in specific markers for interneurons, such as somatostatin and calbindin1. Doublecortin (DCX), which is expressed by migrating immature cells during development, and acetylcholine (ACHE), an early marker of neuronal cells, were highly expressed in reprogrammed cells (Table 26). Transfection with Msi1 or Ngn2 increased the expression of dihydropyrimidinase-like 3 (DPYSL3), an early marker of newborn neurons to five-fold with Msi1 and seven-fold with Ngn2. Expression of microtubule-associated protein 2 (MAP2), an essential marker for development and maintenance of early neuronal morphology, and neuronal cell adhesion molecule (NCAM) were highly expressed with Msi1 and Ngn2. The expression of enolase-2, a marker of mature neurons, was 20-fold enhanced by Msi1 and Ngn2. Member of the NeuroD family NeuroD1 was highly expressed after transfection with Msi1 to 84.22 fold and to 34.27 by Ngn2. Gene expression of growth factors such as IGF-1, IGF-2, NPY and CSF-3 was enhanced following transfection with Msi1 or Ngn2. The expression of VEGF and GDNF genes were increased to almost five-fold and seven-fold by Msi1 and Ngn2, respectively. However in transfected cells, the expression of BDNF, EGF, and bFGF were not activated and even down-regulated as compared to untransfected cells. The expression of growth associated protein (GAP-43), a growth- and regeneration-associated marker of neurite extension, and expression of netrin, implicated in neuronal development and guidance, were highly expressed in transfected cells (Table 26). Expression of receptors for growth and neurotrophic factors was increased, such as type III receptor tyrosine kinase, Neurotrophic tyrosine kinase receptor, and neurotrophic tyrosine kinase. The fibroblast-specific markers vimentin and fibronectin were down-regulated in the reprogrammed cells.

Transfection of HFF with only Msi1 and Ngn2 in the presence of MBD2 increased the expression of glial cells and neuronal cells markers.

TABLE 26

Gene array of CDM transfected with pMsi1 and pNgn2 following the pre-treatment with cytochalasin B (10 µg/ml), VPA (4 mM) and 5-Azacytidine (5 µM). Transfected cells were cultured in differentiation medium (NbActive, BrainBits ™) supplemented by ATRA (5 µM), bFGF (40 ng/ml) and BDNF (20 ng/ml). Gene array of CDM transfected with pMsi1 and pNgn2 following the pre-treatment with cytochalasin B (10 µg/ml), VPA (4 mM) and 5-Azacytidine (5 µM).

| Symbol | Common name and description | Company Gene ID | Relative expression Msi 1 | Relative expression Ngn 2 |
|---|---|---|---|---|
| Astrocytes and oligodendrocytes markers | | | | |
| NKx2-2 | Markers for oligodendrocyte progenitors | NM_002509.2 | 1.72 | 10.19 |
| OLIG2 | Oligodendrocyte lineage transcription factor 2 | NM_005806.2 | 1.72 | 1.52 |
| MBP | Myelin-basic protein | NM-001025090.1 | 1.72 | 1.52 |
| GFAP | Glial fibrillary acidic protein | NM_002055.4 | 6.04 | 2.41 |
| AQP4 | Aquaporin 4 | NM_001650.4 | 1.72 | 1.52 |
| DIO2 | Deiodinase iodothyronine | NM_013989.3 | 8.29 | 10.61 |
| NC markers | | | | |
| SST | Somatostatin, specific marker for interneurons | NM_001048.3 | very high | very high |
| CALB1 | Calbindin 1, interneuron marker | NM_004929.2 | 1.72 | 1.52 |
| Tubulin1A | Are necessary for axonal growth | NM_006009.2 | 0.63 | 0.76 |
| NES | Precursor neurons (nestin) | NM_006617.1 | 2.42 | 2.86 |
| DCX | An early neuronal marker (Doublecortin) | NM_178151.1 | 1.72 | 1.52 |

TABLE 26-continued

Gene array of CDM transfected with pMsi1 and pNgn2 following the pre-treatment with cytochalasin B
(10 µg/ml), VPA (4 mM) and 5-Azacytidine (5 µM). Transfected cells were cultured in differentiation
medium (NbActive, BrainBits ™) supplemented by ATRA (5 µM), bFGF (40 ng/ml) and BDNF (20 ng/ml).
Gene array of CDM transfected with pMsi1 and pNgn2 following the pre-treatment with cytochalasin B
(10 µg/ml), VPA (4 mM) and 5-Azacytidine (5 µM).

| Symbol | Common name and description | Company Gene ID | Relative expression Msi 1 | Relative expression Ngn 2 |
|---|---|---|---|---|
| ACHE | Acetylcholinesterase, marker of early neuronal development | NM_015831.2 | 10.68 | 20.37 |
| ENO2 | A marker for neurons cells, enolase | NM_001975.2 | 0.55 | 0.54 |
| NEUROD1 | Neural marker; expression gradually increased from neural precursor to fully differentiated neuron | NM_002500.2 | 1.72 | 1.50 |
| DPYSL3 | Dihydropyrimidinase-like 3, marker of immature neurons | NM_001387.2 | 0.62 | 0.71 |
| MAP2 | Microtubule-associated protein 2, essential for development of early neuronal morphology and maintenance of adult neuronal morphology | NM_002374.3 | 1.99 | 1.70 |
| NCAM | Neural cell adhesion molecule 1 | NM_18135.3 | 3.11 | 5.72 |
| CEND1 | Cell cycle exit & neuronal differentiation, early marker of proliferating precursor cells that will differentiate to neurons | NM_016564.3 | 6.68 | 8.28 |
| Neuroregeneration and survival genes | | | | |
| FGF2 | Fibroblast growth factor | NM_002006.4 | 1.19 | 1.26 |
| EGF | Epidermal growth factor, | Hs00153181_m1 | 28.37 | 52.13 |
| IGF-1 | Insulin growth factor-1, | NM_000618.2 | 0.82 | 1.03 |
| IGF-2 | Insulin growth factor-2 | NM_0000612.3 | 0.99 | 1.21 |
| CSF3 | Granulocyte colony-stimulating factor | NM_2219.1 | very high | very high |
| BDNF | Brain derived growth factor, neurogenesis | NM-199231.1 | 8.54 | 7.84 |
| GDNF | Glial derived neurotrophic factor | NM-000614.2 | 0.63 | 0.91 |
| CNTF | Ciliary neurotrophic factor | NM_001025366.1 | 3.80 | 14.92 |
| VEGF | Vascular endothelial growth factor | NM_130850.1 | 6.28 | 7.22 |
| BMP-4 | Bone morphogenetic protein 4 | NM_002253.1 | 1.17 | 1.34 |
| KDR | Type III receptor tyrosine kinase) | NM_006180.3 | 113.85 | 43.87 |
| NTRK2 | Neurotrophic tyrosine kinase recepto (TrkB) | NM_000905.2 | 0.02 | 0.02 |
| NPY | Neuropeptide Y | NM_009905.2 | 33.39 | 1.52 |
| NTF-5 | Neurotrophin 5 | NM_006179.3 | 4.43 | 5.93 |
| PIK3CG | phosphoinositide-3-kinase, | NM_002649.2 | 1.70 | 1.50 |
| STAT3 | Signal transduction transcription 3 | NM_213662.1 | 3.15 | 2.24 |
| Gap43 | Growth associated protein 43 | NM_002045.2 | 1.82 | 2.98 |
| NTN1 | Netrin1, implicated in neuronal development and guidance | NM_004822.2 | 0.50 | 0.29 |
| NTRk2 | Neurotrophic tyrosine kinase, receptor, type 2 | NM_006180.3 | 0.02 | 0.02 |
| L1CAM | L1 cell adhesion molecule, associated with regenerating axons | NM_024003.1 | 0.08 | 0.11 |
| LIMK1 | LIM domain kinase 1 | NM_002314.2 | 2.88 | 2.96 |
| Vimentin | Radial glia and fibroblast marker | NM-003380.2 | 0.21 | 0.20 |
| Fibronectin | Fibronectin is a marker for fibroblasts | NM_212474.1 | 0.15 | 0.14 |

Transfected cells were cultured in differentiation medium (NbActive, BrainBits ™) supplemented by ATRA (5 µM), bFGF (40 ng/ml) and BDNF (20 ng/ml).

Example XII

Reprogramming of Cells within CDM by Lipofectamine and Nucleofection

This study was designed to improve transfection of CDM by combining lipofectamine and nucleofection and using two vectors pCMV6-XL5-Msi1 and pCMV6-XL4-Ngn2 individually or in combination together with pCMV-XL5-MBD2. Cells within Day 4 CDM were lipotransfected for 6 hours with Msi1/MBD2, Ngn2/MBD2 or Msi/Ngn2/MBD2 after 2 days of pre-treatment with or without cytochalasin B. In parallel, transfection was performed on fresh HFFs after the 6 hours using Nucleofection as described in Example II, and transferred on top of the CDM when the lipofectamine media was changed to fresh CDM medium. After 24 hours, the medium was changed to Neural Progenitor Basal Medium (NPBM, Lonza) with the presence of Noggin (50 ng/ml, Peprotech), recombinant hFGF (20 ng/ml, Peprotech), and recombinant hEGF (20 ng/ml, Peprotech). Differentiation was induced at day 7, by adding NSA-A differentiation medium (StemCell Technologies) for 21 days.

Gene Expression Analysis

Samples were collected at 8, 15, and 21 days to evaluate the nature of newly formed cells by analyzing the expression of several neuronal marker genes using RT-PCR according to the methods previously described in Example I. As shown in Table 27, cells transfected with one neurogenic transcription factor (Msi1 or Ngn2) express high levels of nestin and βIII-tubulin at day 8. The same pattern of expression was observed at day 15 and 21, while the expression was slightly decreased in the absence of cytochalasin B in cells transfected with Ngn2. The expression of all genes, except the mature neuronal marker MAP2b, were remarkably increased in cells transfected with both neurogenic transcription factors. The upregulation of these genes was slightly reduced in the absence of cytochalasin B, indicating its role in enhancing reprogramming.

TABLE 27

RT-PCR analysis of relative expression of neuronal stem cell markers such as nestin, Sox2, and GFAP after transfection of fibroblast cells within the CDM with different combinations with or without the co-treatment with cytochalasin B. Relative expression of Sox2, nestin, and GFAP in NSLCs was increased after transfection with both transcription factors Ngn2 and Msi1 with MBD2 as the DNA demethylator.

| | MSI1 | | NGN2 | | TUBB3 | | GFAP | | NES | | MAP2 | |
|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| #1 Day8 CDM − CytoB Control | 1.11 | 0.21 | 1.33 | 0.20 | 1.10 | 0.02 | 0.91 | 0.02 | 1.18 | 0.09 | 0.91 | 0.02 |
| #2 Day8 CDM − CytoB Control | 1.11 | 0.17 | 0.65 | 0.08 | 0.92 | 0.06 | 0.91 | 0.11 | 0.82 | 0.01 | 0.91 | 0.11 |
| #3 Day8 CDM − CytoB Control | 0.83 | 0.01 | 0.71 | 0.86 | 0.99 | 0.04 | 1.21 | 0.00 | 1.03 | 0.00 | 1.21 | 0.00 |
| #4 Day8 CDM + CytoB Control | 7.42 | 0.35 | 1.52 | 0.53 | 1.32 | 0.16 | 0.44 | 0.06 | 1.04 | 0.02 | 0.44 | 0.06 |
| #5 Day8 CDM + CytoB Control | 7.01 | 0.42 | 2.14 | 0.58 | 1.23 | 0.07 | 0.62 | 0.05 | 1.02 | 0.06 | 0.62 | 0.05 |
| #6 Day8 CDM + CytoB Control | 9.15 | 0.48 | 0.76 | 0.08 | 0.40 | 0.05 | 0.59 | 0.14 | 0.34 | 0.16 | 0.59 | 0.14 |
| #7 Day15 CDM − CytoB Control | 1.45 | 0.07 | 1.53 | 0.33 | 1.32 | 0.01 | 0.90 | 0.07 | 1.31 | 0.03 | 0.90 | 0.07 |
| #8 Day15 CDM − CytoB Control | 0.79 | 0.02 | 2.01 | 1.49 | 0.91 | 0.03 | 1.14 | 0.16 | 0.91 | 0.01 | 1.14 | 0.16 |
| #9 Day15 CDM − CytoB Control | 0.87 | 0.04 | 0.64 | 0.72 | 0.84 | 0.08 | 0.98 | 0.15 | 0.84 | 0.01 | 0.98 | 0.15 |
| #10 Day15 CDM + CytoB Control | 1.27 | 0.14 | 0.99 | 0.66 | 1.70 | 0.21 | 0.36 | 0.02 | 1.08 | 0.08 | 0.36 | 0.02 |
| #11 Day15 CDM + CytoB Control | 1.39 | 0.04 | 0.97 | 0.65 | 2.65 | 0.38 | 0.44 | 0.06 | 1.97 | 0.30 | 0.44 | 0.06 |
| #12 Day15 CDM + CytoB Control | 1.09 | 0.21 | 0.49 | 0.46 | 1.32 | 0.14 | 0.47 | 0.15 | 2.45 | 0.15 | 0.47 | 0.15 |
| #13 Day21 CDM − CytoB Control | 1.21 | 0.00 | 1.06 | 0.06 | 1.10 | 0.01 | 0.86 | 0.16 | 1.07 | 0.01 | 0.86 | 0.16 |
| #14 Day21 CDM − CytoB Control | 0.97 | 0.09 | 2.16 | 0.77 | 0.96 | 0.01 | 1.11 | 0.10 | 0.94 | 0.01 | 1.11 | 0.10 |
| #15 Day21 CDM − CytoB Control | 0.86 | 0.02 | 1.01 | 1.27 | 0.94 | 0.00 | 1.08 | 0.26 | 0.99 | 0.04 | 1.08 | 0.26 |
| #16 Day21 CDM + CytoB Control | 1.41 | 0.21 | 1.29 | 1.64 | 2.46 | 0.07 | 0.88 | 0.22 | 1.58 | 0.05 | 0.88 | 0.22 |
| #17 Day21 CDM + CytoB Control | 2.24 | 0.00 | 0.35 | 0.01 | 2.23 | 0.03 | 0.55 | 0.16 | 1.57 | 0.02 | 0.55 | 0.16 |
| #18 Day21 CDM + CytoB Control | 2.18 | 0.14 | 0.77 | 0.06 | 2.29 | 0.12 | 0.54 | 0.04 | 1.47 | 0.04 | 0.54 | 0.04 |
| #19 Day8 CDM − CytoB Msi1/MBD2 | 694.16 | 18.10 | 0.51 | 0.05 | 1.46 | 0.04 | 2.18 | 0.13 | 1.02 | 0.03 | 2.18 | 0.13 |
| #20 Day8 CDM − CytoB Ngn2/MBD2 | 2.38 | 0.29 | 4106.88 | 48.57 | 0.46 | 0.02 | 1.88 | 0.14 | 0.99 | 0.02 | 1.88 | 0.14 |
| #21 Day8 CDM − CytoB Msi1/Ngn2/MBD2 | 365.04 | 6.71 | 2702.81 | 55.69 | 4.44 | 0.02 | 2.95 | 0.38 | 5.11 | 0.05 | 2.95 | 0.38 |
| #22 Day8 CDM + CytoB Msi1/MBD2 | 1262.00 | 63.21 | 0.75 | 0.91 | 0.54 | 0.03 | 2.48 | 0.11 | 1.16 | 0.05 | 2.48 | 0.11 |
| #23 Day8 CDM + CytoB Ngn2/MBD2 | 2.34 | 0.20 | 10963.51 | 19.89 | 0.53 | 0.00 | 2.27 | 0.26 | 1.00 | 0.06 | 2.27 | 0.26 |
| #24 Day8 CDM + CytoB Msi1/Ngn2/MBD2 | 869.15 | 65.33 | 6401.28 | 87.12 | 4.58 | 0.01 | 3.65 | 0.13 | 3.15 | 0.00 | 3.65 | 0.13 |
| #25 Day15 CDM − CytoB Msi1/MBD2 | 41.07 | 1.74 | 2.58 | 0.36 | 1.43 | 0.05 | 0.58 | 0.06 | 1.34 | 0.07 | 0.58 | 0.06 |
| #26 Day15 CDM − CytoB Ngn2/MBD2 | 0.73 | 0.02 | 2192.64 | 15.74 | 0.95 | 0.08 | 1.01 | 0.09 | 0.99 | 0.03 | 1.01 | 0.09 |
| #27 Day15 CDM − CytoB Msi1/Ngn2/MBD2 | 45.59 | 2.33 | 3318.42 | 51.51 | 5.32 | 0.08 | 3.80 | 0.01 | 4.32 | 0.01 | 4.80 | 0.01 |
| #28 Day15 CDM + CytoB Msi1/MBD2 | 106.34 | 4.43 | 4.90 | 1.70 | 1.47 | 0.01 | 0.57 | 0.10 | 1.19 | 0.03 | 0.57 | 0.10 |
| #29 Day15 CDM + CytoB Ngn2/MBD2 | 1.09 | 0.11 | 6715.95 | 505.86 | 1.30 | 0.05 | 0.70 | 0.17 | 1.18 | 0.07 | 0.70 | 0.17 |
| #30 Day15 CDM + CytoB Msi1/Ngn2/MBD2 | 46.77 | 0.76 | 2816.33 | 90.83 | 5.76 | 0.02 | 4.52 | 0.09 | 3.60 | 0.03 | 5.52 | 0.09 |
| #31 Day21 CDM − CytoB Msi1/MBD2 | 22.94 | 1.09 | 10.09 | 2.72 | 1.08 | 0.07 | 0.58 | 0.08 | 1.17 | 0.02 | 0.58 | 0.08 |
| #32 Day21 CDM − CytoB Ngn2/MBD2 | 0.78 | 0.02 | 4450.56 | 255.75 | 1.00 | 0.03 | 0.75 | 0.21 | 1.09 | 0.03 | 0.75 | 0.21 |
| #33 Day21 CDM − CytoB Msi1/Ngn2/MBD2 | 24.02 | 0.86 | 2509.95 | 64.00 | 5.18 | 0.05 | 4.74 | 0.16 | 4.37 | 0.06 | 3.74 | 0.16 |
| #34 Day21 CDM + CytoB Msi1/MBD2 | 54.17 | 1.41 | 8.31 | 3.32 | 1.42 | 0.05 | 0.70 | 0.22 | 1.71 | 0.02 | 0.70 | 0.22 |
| #35 Day21 CDM + CytoB Ngn2/MBD2 | 1.19 | 0.15 | 1180.19 | 27.29 | 1.21 | 0.06 | 1.03 | 0.34 | 1.31 | 0.04 | 1.03 | 0.34 |
| #36 Day21 CDM + CytoB Msi1/Ngn2/MBD2 | 81.66 | 1.34 | 7789.96 | 345.72 | 5.24 | 0.05 | 5.84 | 0.10 | 4.37 | 0.05 | 5.84 | 0.10 |

Immunohistochemical Analysis

Samples were collected at 4, 8, 14, and 21 days to evaluate the nature of any reprogrammed cells by analyzing the expression of several neuronal markers using immunohistochemical analysis according to the methods previously described in Example I. The immunohistochemical analysis at various time points revealed that within the first 8 days the expression of nestin was induced in a large proportion of cells and decreased time-dependently after inducing the differentiation.

This study indicates that upon transfecting the cells with one or two neurogenic genes in the presence of cytochalasin B and MBD2, reprogrammed cells were stable in culture, responded to environmental changes (proliferation vs differentiation), and expressed neuronal markers for at least 24 days in culture.

Example XIII

Telomerase Activity of NSLCs

Telomerase is active in neural precursor cells and suggest that its regulation is an important parameter for cellular proliferation to occur in the mammalian brain (Caporaso G L et, 2003). This study was performed to evaluate telomerase activity in cell extracts of adherent NSLCs (NSLCs cultured on laminin-coated plates) as well as NSLCs in floating neurospheres (NSLCs cultured in plates with a low-bind surface) at early (P7) and late passage (P27). The telomerase activity of the 4 samples was measured by the PCR-based telomere repeat amplification protocol (TRAP) using the TRAPeze® Telomerase Detection Kit (Chemicon). Briefly, the cells were grown in 24-well plates, washed in PBS, and homogenized for 30 min on ice in buffer containing 10 mM Tris-HCl, pH 7.5, 1 mM $MgCl_2$, 1 mM EGTA, 0.1 mM Benzamidine, 5 mM β-mercaptoethanol, 0.5% CHAPS and 10% Glycerol (1×CHAPS Lysis Buffer, provided in kit) and RNase Inhibitor. The samples were spun down and the protein concentration of the supernatant was determined using the BCA Assay. 900 ng of protein from each cell extract was added directly to the TRAP reaction mixture containing TRAP reaction buffer, dNTPs, template substrate (TS) primer, TRAP primer mix and Taq polymerase. The reaction mixtures were incubated at 30° C. for 30 minutes for template synthesis, followed by a PCR procedure (95° C./15 min for initial denaturation, 94° C./30 sec, 59° C./30 sec, 72° C./1 min for 32 cycles) for amplification of the extended telomerase products. To detect telomerase activity, polyacrylamide gel electrophoresis (PAGE) was performed for the reaction products on a 10% non-denaturing TBE gel. After electrophoresis, the gel was stained with SYBR® Green I Nucleic Acid Gel Stain for 30 minutes, followed by Image capture using a Gel-Documentation System (Alpha Innotech).

All 4 samples were telomerase positive (as indicated by the TRAP product ladder). As expected, the Heat-treated control (ΔH) showed no Telomerase activity (Negative Control). A 36 bp internal control band (S-IC) is used to monitor PCR amplification (to distinguish false-negative results). This S-IC band was observed for all samples except for the test samples. This may have been due to the excessively high telomerase activity in the test samples; amplification of the TRAP products and the S-IC control band are semi-competitive. All controls gave expected results (No TRAP products for CHAPS ctrl, and TRAP ladder of products for the positive control cells and the TSR8 control).

Example XIV

Tumor Formation Assay

Malignantly transformed cells show reduced requirements for extracellular growth promoting factors, are not restricted by cell-cell contact, and are often immortal. Anchorage-independent growth and proliferation is one of the hallmarks of malignant transformation, which is considered the most accurate and stringent in vitro assay for detecting malignant transformation of cells.

Adherent and neurosphere NSLCs at early and late passage (P7 and P25), as well as normal human neuroprogenitor cells (hNPCs), were investigated for the anchorage-independent growth. HFFs were used as a negative control and cervical carcinoma HeLa cells were used as a positive control. Cells were sedimented by centrifugation at 150×g for 3 min at room temperature (RT). The assay was performed using the CytoSelect™ 96-well cell transformation assay (CellBiolabs). The base agar layer (1.2%) was dissolved in 2×DMEM/20% PBS solution and 50 μl of the agar solution was added to the plate and incubated for 30 min at 4° C. to solidify. Prior to adding the cell agar layer, the plate was allowed to warm up for 15 minutes at 37° C. The cells were resuspended at different density (20.000 and 5000 cells/well), except the hNPCs were resuspended only at 5000 cells/well due to a lack of enough cells. The cells were mixed with the 1.2% agar solution, 2×DMEM/20% PBS, and cell suspension (1:1:1), and 75 μl of the mixture was transferred to wells already containing the solidified base agar layer, and was then placed in 4° C. for 15 minutes to allow the cell agar layer to solidify. 100 μl of proliferation medium (StemCell Technologies) was added and the plate was incubated for 8 days at 37° C. and 5% $CO_2$ before being solubilized, lysed and detected by the CyQuant™ GR dye in a fluorescence plate reader. The fluorescence measurement was performed using the Flexstation™ (Molecular Devices) with a 485/538 nm filter.

TABLE 28

Fluorescence measurement (Relative Fluorescence Unit, RFU) indicate that under the same conditions only carcinoma HeLa cells grow as an anchorage-independent colony, while both hNPCs and NSLCs (adherent and floating neurospheres) were negative for tumor growth in the standard agar plate tumor formation assay (CytoSelect ™ cell transformation kit, Cell Biolabs Inc.).

| Cell density | Cell types | | | |
|---|---|---|---|---|
| | Hela | HFF | NSLCs | HNPCs |
| 20.000 | 60.05 ± 8.70 | 14.82 ± 1.57 | 19.22 ± 1.85 | 19.00 ± 2.71 |
| 10.000 | 39.03 ± 3.97 | 13.73 ± 1.05 | 14.99 ± 1.12 | 21.61 ± 9.95 |
| 5000 | 24.70 ± 3.89 | 11.65 ± 0.57 | 12.29 ± 0.79 | 12.45 ± 0.73 |

As shown in Table 28, fluorescence measurement indicated that under the same conditions only carcinoma HeLa cells significantly grew and proliferated as anchorage-independent colonies, while both hNPCs and NSLCs (adherent and floating neurospheres) were negative for tumor growth (same value as HFFs (negative control) for 5,000 and 10,000 cells) in the standard agar plate tumor formation assay by visual observation of cells by light microscopic observation using bright field at 10× confirm Fluorescence measurement. Thus the transient transfection method and genes used allows the reprogramming of cells without the neoplastic transformation that generally occurs with stable transfection or certain genes via a series of genetic and epigenetic alterations that yield a cell population that is capable of proliferating independently of both external and internal signals that normally restrain growth.

Example XVI

No Genomic Integration of Plasmid DNA in NSLCs from Transient Transfection

The DNA plasmid Msi1/Ngn2 (designed and constructed in house) was used in transient transfection for generation of NSLCs along with MBD2 (for sample 1), or 5-Aza and VPA (for sample 2). Two weeks after transfection, Southern blot was performed to test for possible genomic integration of the plasmid DNA. 3 μg of genomic DNA extracted from the NSLC samples, as well as from HFF (a human fibroblast cell line) used as a negative control, was digested with several restriction enzymes including BglII, PstI and StuI, subjected to electrophoresis on a 1% agarose gel and transferred to a positively charged nylon membrane (Roche). The membrane was hybridized in the DIG Easy Hyb™ buffer (Roche) at 42° C. overnight with a 1.2 kb Dig-labeled PCR probe amplified from the plasmid DNA using a set of primers. The membrane was washed twice at room temperature with 2×SSC, 0.1% SDS for 5 min per wash, twice with 0.5×SSC, 0.1% SDS at 65° C. for 15 min per wash. Hybridization signals of the membrane were detected using the CDP-Star™ substrate (Roche). The membrane was exposed to an X-ray film for analysis. The signals were stripped from the membrane using stripping buffer (0.2M NaOH, 0.1% SDS). The membrane was re-hybridized with a 0.9 kb Dig-labeled PCR probe amplified from the plasmid DNA using a set of primers.

The Southern blot analysis with the 1.2 kb Dig-labeled PCR probe revealed distinct signals in the positive control samples where the Msi1/Ngn2 plasmid DNA was spiked into HFF genomic DNA for the equivalence of 1, 10 or 100 Integrations per genome. There were a few weak and identical bands that appeared in the restriction enzyme digested genomic DNA from HFF, NSLC samples #1 and #2, suggesting that there is no plasmid DNA integration in the genomic DNA of NSLCs. These bands may represent the endogenous Ngn2 gene since the 1.2 kb Dig-labeled PCR probe contains a small part of the Ngn2 gene. This data shows that no, or only a tiny number of, NSLCs had plasmid integration into the host genome after transient transfection, and that the transfected genes are only present in the cell for a short period of time (less than two weeks).

Example XVII

Neuroprotective Effect of Transplanted hNSLCs in:
1) Animal Model of Multiple Sclerosis.

Multiple Sclerosis (MS) is an incurable inflammatory demyelinating disease of the central nervous system (CNS) (Frohman E M et al 2006). Therapies for MS rely on manipulation of the immune system, but with often modest effectiveness on reducing clinical episodes or permanent neurological disability, requiring frequent injections, and with sometimes-significant side effects (Langer-Gould A et al 2004). Experimental Allergic Encephalomyelitis (EAE) is an animal model of MS commonly used for studying disease mechanisms and testing potential therapies. EAE can be induced in a variety of species and strains of animals [mice, Rat, marmoset monkey, rhesus macaques] using various CNS antigens [Myelin Oligodendrocyte Glycoprotein (MOG), proteolipid protein (PLP) and myelin basic protein (MBP)].

After obtaining all appropriate animal approvals for the experiments, Female 7 to 8 weeks old C57BL/6 mice were purchased from Charles Rivers, and housed at MISPRO animal facility for one week before experimentation for adaptation to the new environment C57BL/6 mice were injected s.c. with 100 μg MOG 35-55 in CFA (Sheldon Biotechnology, McGill University) containing 5 mg/ml *Mycobacterium tuberculosis* H37Ra (Difco, Inc), at 2 sites on the back. All mice received 200 ng pertussis toxin (List Biological Laboratories, Inc) i.p. on day 0 and 2, while clinical scores were calculated blindly daily during a 43 day period, according to the 0-5 scale as follows: 1, limp tail or waddling gait with tail tonicity; 2, waddling gait with limp tail (ataxia); 2.5, ataxia with partial limb paralysis; 3, full paralysis of 1 limb; 3.5, full paralysis of 1 limb with partial paralysis of second limb; 4, full paralysis of 2 limbs; 4.5, moribund; and 5, death.

Treatment of EAE Animal Model with and without the Cells:

hNSLC and hNPCs ($1.5 \times 10^6$ cells in 200 μl PBS/each mouse) were given by single injection i.v. via the tall vein when the animals started to show symptoms of EAE (day 13 i.v). Both animals groups received cyclosporine (10 mg/kg/day) one day before the injection of cells and daily from the day of transplantation to avoid any rejection of the human cells. Sham-treated age-, sex-, and strain-matched mice, injected i.p. with PBS alone, were used as controls. All groups of animals were observed for 43 days. Animals were sacrificed at 43 days p.t., brains and spinal cord were harvested in 30% sucrose in PBS. Statistical analysis of the clinical scores revealed that the clinical signs of EAE were significantly attenuated in NSLC-injected animals as compared to control and hNPCs-injected animals. Cumulative scores was significantly reduced in the NSLC transplanted animals and the treatment has no effect on body weight.

2) Hemiplegic Animal Model (Unilateral Ablation of the Left Sensorimotor Cortex in Adult Rats).

After obtaining all appropriate animal approvals for the experiments, 8 rats per group (Sprague-Dawley, 250-300 g, Charles River) were anaesthetized using ketamine (Bimeda-MTC)/xylazine (50/10 mg/kg, Novopharm) and placed onto a stereotaxic frame. A midline cranial incision was performed with a sterile surgical scalpel blade, the cranial vault exposed and the bregma identified. The skull above the sensorimotor cortex was opened and the sensorimotor cortex area [0.5-4.0 mm caudal to bregma and 1.8-3.8 mm lateral to the midline (Paxinos and Watson 1986)] was carefully aspirated. After ablation, the treatments (Alginate, Alginate+ hNPC, Alginate+NSLCs, $RM_x$+NSLCs, $RM_x$ Only, Fibrin Gel, or Saline) were applied directly on the brain after ablation. The opening in the skull was then filled with Bone Wax. In case of a bleeding, small pieces of sterile homeostatic tissue were inserted into the lesion in order to stop the bleeding. The sutures were performed using Ethicon™ monofilament suture ½ circle needle shape. Surgeries were performed in sterile clean rooms, and topical antibiotics (Cicatrin®, GlaxoSmithKline) were applied to the exposed skull and scalp to limit local infection. Rats were immuno-suppressed by daily injection i.p. of cyclosporine A (10 mg/kg/day) starting the day before the surgery until the end of the study period. The purpose of the cyclosporine A injection was to reduce the rat's immune reaction to the treatment. The immune-suppression was sustained until the end of the study to ensure that any potential failure of regeneration (if taken place) was not due to the immune reaction against the treatment. Functional scores were performed weekly, in all groups, sensorimotor impairment was evaluated based on the behavioural tests as described below.

Rotarod Test:

The rotarod speed was manually calibrated for the 10 and 20 RPM speed before all procedures. Animals were required to perch on the stationary rod for 30 sec to acclimate themselves to the environment. During this time, if any animal fell, it was placed back on the rod until it had achieved stationary capabilities for a period of 30 seconds. The animals were allowed 3 trials. The animals that were comfortable staying on the stationary rod for 30 sec were allowed to run with a constant speed of 10 and 20 RPM for 60 sec, and the number of falls were electronically recorded.

Beam Walking:

Beam walking measures hindlimb coordination by means of distance traveled across 100 cm beam (2.3 cm in diameter, 48 cm off the floor). Rats were systematically trained to walk along the elevated beam from start to finish with the aim of completing the task. A safe location, i.e., a flat box, is placed at the end of the beam so that the rat is motivated to complete the task.

| Scale used for evaluation of beam-walking performance | |
|---|---|
| Scale | Performance characteristic |
| 1 | Animals fail to traverse the beam and do not place the hindlimb on the horizontal surface of the beam |
| 2 | Animals fail to traverse the beam, but place the hindlimb on the horizontal surface of the beam and maintain balance |
| 3 | Animals traverse the beam while dragging the hindlimb |
| 4 | Animals traverse the beam and place the hindlimb at least once during the traverse |
| 5 | Animals traverse the beam using the hindlimp to aid less than 50% of its steps on the beam |
| 6 | Animals traverse the beam using the left hindlimb to aid more than 50% of its steps on the beam |
| 7 | Animals traverse the beam with no more than two foot slips |
| 8 | Normal animals |

Before the surgery, all the animals fell at least once from the rotarod, not because they had a walking or coordination problem, but because the speed was high. After the surgery (2 days), all the animals showed signs of significant walking and coordination problems leading to an increase in the number of falls from the rotarod. Three weeks after the surgery, the number of falls was clearly reduced for the animals receiving NSLCs as treatment compared to controls.

Animals passed the beam-walking test before the surgery without any difficulty. The rats crossed the 100 cm beam and got to the safe spot without falling off the beam. Two days after surgery, all groups completely failed to pass the test, and the animals were not able to stay in balance on the beam. One week after the surgery, all the animals showed some improvement in their walking capacity, but no significant difference was noticeable between the different treated groups. From week 4 until week 26, the animals treated with NSLCs as well as $RM_x$ showed significant improvements in their walking capacity compared to the controls.

Example XVIII

Transfection of HFF by Various Combinations of Genes Using the Shuttle® Device and Treatment with Different Small Molecules for Reprogramming to Mesendoderm-Like Cells HFF cells were cultured as described in CDM II medium as described in Example I with only modifying EGF (5 ng/ml) and FGF (10 ng/ml), and transfecting using the Nucleofector™96-well Shuttle® Device (Lonza) following the procedure described in Example IV. The cells were transfected with various combinations of cDNA clones as described in Table 29. After transfection, the cells were plated on 0.1% Gelatin-coated plates and incubated at 37° C., 5% $CO_2$, 5% $O_2$. Medium was changed every other day according to Table 30. Cells were analyzed at Day 4 by Quantitative Real-time PCR.

TABLE 29

Various combinations of plasmids with potential to transfect the cells towards mesendoderm lineage.

| | Day −2 to Day 0 | Plasmids transfected at Day 0[1] |
|---|---|---|
| 1 | Untreated | Oct4, FoxD3, MBD2 |
| 2 | | Oct4, T, MBD2 |
| 3 | | Oct4, Mixl1, MBD2 |
| 4 | | Oct4, Sox17, MBD2 |
| 5 | | FoxD3, T, MBD2 |
| 6 | | FoxD3, Mixl1, MBD2 |
| 7 | | FoxD3, Sox17, MBD2 |
| 8 | | T, Mixl1, MBD2 |
| 9 | | T, Sox17, MBD2 |
| 10 | | Mixl1, Sox17, MBD2 |
| 13 | Pre-treated | Oct4, FoxD3 |
| 14 | with | FoxD3, T |
| 15 | VPA & 5-Aza | FoxD3, Mixl1 |
| 16 | | FoxD3, Sox17 |
| 17 | | Oct4, FoxD3, T |
| 18 | | Mixl1, Sox17, FoxA2 |
| 19 | | Oct4, FoxD3, T |
| 20 | | Mixl1, Sox17, FoxA2 |

[1]where Oct4 = pCMV6-XL4-Oct4, FoxD3 = pCMV6-XL5-FoxD3, MBD2 = pCMV6-AC-MBD2, T = pCMV6-XL5-T, Mixl1 = pCMV6-XL5-MIXL1, Sox17 = pCMV6-XL4-SOX17, FoxA2 = pCMV6-XL5-FOXA2. All clones were purchased from Origene and prepared using the EndoFree Plasmid Maxi Kit (Qiagen).

TABLE 30

Medium composition from Day −2 to Day 10
Media Composition[2]

| Day 0 | Day 1 | Day 2 to Day 3 | Day 4 to Day 7 | Day 8 to Day 10 |
|---|---|---|---|---|
| CDM II (3:1 of DMEM:F12; GlutaMAX™ 100x, Dexthamesone, 19.7 µg/ml, Glutathione (500 µg/ml, L-Ascorbic 75 mg/ml, Selenious acid 2.5 µg/ml, | CDM II (50%) + IMDM/F12 (50%) + NEAA + ITS + HSA + bFGF + EGF + VPA + Activin A + CHIR99021 | IMDM/F12 + NEAA + ITS + HSA + bFGF + EGF + VPA + Activin A + CHIR99021 + BMP4 | IMDM/F12 + NEAA + ITS + HSA + bFGF + EGF + Activin A + CHIR99021 + BMP4 | IMDM/F12 + NEAA + ITS + HSA + bFGF + EGF + BMP4 |

TABLE 30-continued

Medium composition from Day −2 to Day 10
Media Composition[2]

| Day 0 | Day 1 | Day 2 to Day 3 | Day 4 to Day 7 | Day 8 to Day 10 |
|---|---|---|---|---|
| Insulin solution 10 mg/ml, T3 675 ng/ml, ethanolamine 500X, bFGF 2.5 ug/ml, and Egf (1.25 ug/ml) + Activin A + HSA | | | | |

[2]Supplements added to media at the following concentrations: Activin A (Peprotech, 30 ng/ml), HSA (Baxter, 0.5%), NEAA (Gibco, 1X), ITS (Gibco, 1X), EGF (Peprotech, 5 ng/ml), bFGF (Peprotech, 10 ng/ml), CHIR99021 (Stemgent, 2 uM), VPA (Stemgent, 1 mM), 5-Aza (Sigma, 0.5 uM), BMP4 (Peprotech, 10 ng/ml)

Cells were collected on Day 4 by detaching with TrypLE™, followed by centrifugation at 80×g for 5 minutes. Supernatant was aspirated and the cell pellet was frozen at −86° C. until ready for RNA Isolation. RNA isolation and quantification was performed as previously described in Example I. cDNA was prepared and quantitative real-time PCR was performed as previously described in Example II, except the following Taqman™ Gene Expression Assays (Applied Biosystems) were used:

| Gene | Taqman ™ ® Assay ID |
|---|---|
| GAPDH (housekeeper) | Hs99999905_m1 |
| PPIA (housekeeper) | Hs99999904_m1 |
| FOXA2 | Hs00232764_m1 |
| SOX17 | Hs00751752_s1 |
| Endogenous T | Hs00610073_g1 |
| GSC | Hs00418279_m1 |
| CXCR4 | Hs00607978_s1 |
| GATA4 | Hs00171403_m1 |
| CER1 | Hs00193796_m1 |
| CDH1 (E-cadherin) | Hs01023894_m1 |
| p63 | Hs00978340_m1 |
| SOX2 | SOX2_1078-ANY |

TABLE 31

Relative Expression FoxA2, Sox17, and Cxcr4 after transfecting HFFs once with various gene combinations with potential to reprogram cells into mesoendoderm-like cells. The exact values are not significantly accurate due to low RNA yield, however a trend of increasing gene expression was detected for FoxA2, Sox17, and CXCR4.

| | FOXA2 | | SOX17 | | CXCR4 | |
|---|---|---|---|---|---|---|
| | Rel. Exp. | Std. Dev. | Rel. Exp. | Std. Dev. | Rel. Exp. | Std. Dev. |
| Untreated HFF | 1.00 | 0.04 | 1.00 | 0.04 | 1.00 | 0.04 |
| Day4 HFF untransf. (+G.F), | 1.01 | 0.06 | 1.01 | 0.06 | 4.77 | 2.51 |
| Day4 HFF untransf. (−G.F), | 1.38 | 0.11 | 1.38 | 0.11 | 1.38 | 0.11 |
| Day4 HFF Untransf. (+G.F.), | 0.98 | 0.02 | 0.98 | 0.02 | 3.32 | 3.31 |
| Day4 HFF Untransf. (−G.F.), | 4.12 | 4.07 | 1.28 | 0.06 | 1.28 | 0.06 |
| Day4 Oct4/FoxD3/MBD2 | 4.67 | 4.60 | 3.19 | 2.78 | 76.43 | 7.91 |
| Day4 Oct4/T/MBD2 | 3.91 | 3.55 | 4.33 | 2.36 | 15.18 | 2.52 |
| Day4 Oct4/Mixl1/MBD2 | 2.66 | 1.77 | 10.33 | 0.43 | 7.31 | 3.21 |
| Day4 Oct4/Sox17/MBD2 | 14.19 | 4.85 | 413533.31 | 127089.61 | 56.04 | 0.71 |
| Day4 FoxD3/T/MBD2 | 38.62 | 38.00 | 3.12 | 1.32 | 42.41 | 5.23 |
| Day4 FoxD3/Mixl1/MBD2 | 7.76 | 5.29 | 2.41 | 0.30 | 137.17 | 27.74 |
| Day4 FoxD3/Sox17/MBD2 | 26.02 | 1.95 | 50904.45 | 1523.33 | 131.03 | 17.53 |
| Day4 T/Mixl1/MBD2 | 3.67 | 3.26 | 5.64 | 4.15 | 14.04 | 2.89 |
| Day4 T/Sox17/MBD2 | 9.76 | 9.70 | 209797.21 | 24533.81 | 111.35 | 16.40 |
| Day4 Mixl1/Sox17/MBD2 | 3.60 | 3.10 | 237310.10 | 57448.60 | 36.76 | 1.07 |
| Day4 Oct4/FoxD3 | 13.87 | 0.16 | 13.87 | 0.16 | 35.44 | 14.57 |
| Day4 FoxD3/T | 60.93 | 60.18 | 19.45 | 1.51 | 19.45 | 1.51 |
| Day4 FoxD3/Mixl1 | 21.20 | 2.31 | 28.96 | 8.66 | 62.31 | 55.82 |
| Day4 FoxD3/Sox17 | 96.88 | 3.60 | 54177.20 | 3313.15 | 44.57 | 41.51 |

TABLE 31-continued

Relative Expression FoxA2, Sox17, and Cxcr4 after transfecting HFFs once with various gene combinations with potential to reprogram cells into mesoendoderm-like cells. The exact values are not significantly accurate due to low RNA yield, however a trend of increasing gene expression was detected for FoxA2, Sox17, and CXCR4.

|  | FOXA2 | | SOX17 | | CXCR4 | |
| --- | --- | --- | --- | --- | --- | --- |
|  | Rel. Exp. | Std. Dev. | Rel. Exp. | Std. Dev. | Rel. Exp. | Std. Dev. |
| Day4 Oct4/FoxD3/T | 25.99 | 18.15 | 12.27 | 1.26 | 21.17 | 11.33 |
| Day4 Mixl1/Sox17/FoxA2 | 1850864.68 | 98259.84 | 112641.65 | 15923.21 | 23.18 | 23.10 |
| Day4 Oct4/FoxD3/T (IMDM/F12) | 9.52 | 5.61 | 1.52 | 0.02 | 35.74 | 4.36 |
| Day4 Mixl1/Sox17/FoxA2 (IMDM/F12) | 486705.82 | 19101.53 | 57060.09 | 1262.81 | 13.44 | 2.36 |

TABLE 32

Expression of GATA4, CDH1 (E-cadherin), p63, and SOX2 relative to untreated HFF control 4 days after transfecting HFF cells with various gene combinations with potential to reprogram cells into mesoendoderm-like cells.

|  | GATA4 | | CDH1 (E-cadherin) | | p63 | | SOX2 | |
| --- | --- | --- | --- | --- | --- | --- | --- | --- |
|  | Rel. Exp. | Std. Dev. | Rel. Exp. | Std. Dev. | Rel. Exp. | Std. Dev. | Rel. Exp. | Std. Dev. |
| Untreated HFF | 1.00 | 0.04 | 1.00 | 0.04 | 1.00 | 0.04 | 1.00 | 0.04 |
| Day4 HFF untransf. (+G.F), | 12.13 | 0.70 | 1.01 | 0.06 | 3.09 | 1.45 | 1.11 | 0.21 |
| Day4 HFF untransf. (−G.F), | 4.48 | 0.85 | 1.38 | 0.11 | 3.11 | 2.54 | 1.38 | 0.11 |
| Day4 HFF Untransf. (+G.F.), | 2.37 | 2.00 | 0.98 | 0.02 | 4.41 | 4.40 | 1.94 | 1.34 |
| Day4 HFF Untransf. (−G.F.), | 6.12 | 3.33 | 1.28 | 0.06 | 13.23 | 7.43 | 1.28 | 0.06 |
| Day4 Oct4/FoxD3/MBD2 | 95.23 | 27.44 | 98.90 | 21.58 | 1.81 | 0.86 | 12.72 | 1.53 |
| Day4 Oct4/T/MBD2 | 33.66 | 10.30 | 1.42 | 0.02 | 2.05 | 0.87 | 2.62 | 1.67 |
| Day4 Oct4/Mixl1/MBD2 | 106.33 | 5.70 | 1.43 | 0.03 | 8.68 | 0.99 | 25.68 | 2.18 |
| Day4 Oct4/Sox17/MBD2 | 23.50 | 5.39 | 4.65 | 4.43 | 95.23 | 13.86 | 18.77 | 6.94 |
| Day4 FoxD3/T/MBD2 | 121.36 | 11.68 | 26.85 | 0.02 | 2.22 | 0.04 | 16.99 | 4.74 |
| Day4 FoxD3/Mixl1/MBD2 | 130.21 | 21.04 | 69.19 | 22.84 | 4.05 | 3.56 | 1.52 | 0.01 |
| Day4 FoxD3/Sox17/MBD2 | 99.49 | 30.30 | 6.89 | 3.69 | 1.78 | 0.01 | 15.19 | 9.08 |
| Day4 T/Mixl1/MBD2 | 110.30 | 3.55 | 1.36 | 0.00 | 1.36 | 0.00 | 6.64 | 2.25 |
| Day4 T/Sox17/MBD2 | 53.19 | 4.02 | 2.69 | 1.86 | 18.01 | 0.54 | 14.21 | 5.21 |
| Day4 Mixl1/Sox17/MBD2 | 16.53 | 16.50 | 2.91 | 2.13 | 13.44 | 6.68 | 10.55 | 3.27 |
| Day4 Oct4/FoxD3 | 66.45 | 26.34 | 47.31 | 47.30 | 13.87 | 0.16 | 23.87 | 14.31 |
| Day4 FoxD3/T | 68.25 | 68.00 | 39.08 | 29.27 | 19.45 | 1.51 | 19.45 | 1.51 |
| Day4 FoxD3/Mixl1 | 78.18 | 78.00 | 21.20 | 2.31 | 21.20 | 2.31 | 25.10 | 3.20 |
| Day4 FoxD3/Sox17 | 176.45 | 93.54 | 15.64 | 0.60 | 15.64 | 0.60 | 26.78 | 16.35 |
| Day4 Oct4/FoxD3/T | 12.27 | 1.26 | 12.27 | 1.26 | 12.27 | 1.26 | 12.27 | 1.26 |
| Day4 Mixl1/Sox17/FoxA2 | 85.89 | 64.52 | 20.06 | 20.00 | 3.67 | 0.13 | 13.66 | 0.66 |
| Day4 Oct4/FoxD3/T | 89.05 | 50.00 | 10.40 | 8.14 | 1.52 | 0.02 | 1.52 | 0.02 |
| Day4 Mixl1/Sox17/FoxA2 | 6.16 | 6.10 | 1.23 | 0.04 | 1.23 | 0.04 | 1.23 | 0.04 |

Identification of gene combinations that may induce the formation of Mesendoderm-like cells was investigated by transfection with combinations of Oct4, Sox17, FoxD3, T, Mixl1, FoxA2, and MBD2. As shown in Table 25 and 26, the Relative Expression of CXCR4 and GATA4, both Mesendoderm/Endoderm/Mesoderm markers, appear to be up-regulated in various combinations, most noticeably in FoxD3/Mixl1/MBD2 and FoxD3/Sox17/MBD2. Similarly, FOXA2, a marker for Endoderm and Mesoderm, was up-regulated FoxD3/Sox17-transfected sample, although the expression is still very low. Four days following transfection, SOX17 is still highly expressed in the SOX17-transfected samples (50,000 to 400,000-fold as compared to the untreated HFF sample). The SOX17 gene expression represents leftover plasmid DNA (exogenous SOX17) that still remains 4 days post-transfection, and any endogenous SOX17 expression that may have been induced. Ectoderm markers CDH1, p63 and Sox2 were also up-regulated in some samples (e.g. Oct4/FoxD3/MBD2, Oct4/Sox17/MBD2).

Reprogramming HFFs into Pancreatic Progenitor-Like Cells:

HFF cells were cultured as described in Example I, and transfected using the Nucleofector™ 96-well Shuttle® Device (Lonza) following the procedure described in Example IV. The cells were transfected with various combinations of cDNA clones as described in Table 27. After transfection, the cells were plated on Fibronectin-coated collagen gels and incubated at 37° C., 5% $CO_2$, 5% $O_2$. Fibronectin-coated Collagen gel plates were prepared prior to transfection. Rat Tail Collagen I (Gibco) was diluted to 1.125 mg/ml using 10×PBS and distilled water, where 125 µl was added to each well of a 24-well plate and incubated in 37° C. for 40 minutes. After rinsing with 1×PBS, Fibronectin (BD Biosciences) was added on top of the gel at a concentration of 1.9 ug/well. Media was changed every other day according to Table 33. Cells were analyzed at Day 7 by Quantitative Real-time PCR.

Cells were collected on Day 7 and RNA isolation and quantification was performed as previously described in Example I. cDNA was prepared and quantitative real-time PCR was performed as previously described in Example II, except the following Taqman™ Gene Expression Assays (Applied Biosystems) were used:

| Gene | Taqman™ ® Assay ID |
|---|---|
| GAPDH (housekeeper) | Hs99999905_m1 |
| PPIA (housekeeper) | Hs99999904_m1 |
| FOXA2 | Hs00232764_m1 |
| SOX17 | Hs00751752_s1 |
| GATA4 | Hs00171403_m1 |
| Endo PDX1 | PDX1_1201 |
| SOX9 | Hs00165814_m1 |
| Ngn3 | Hs01875204_s1 |
| NKX2-2 | Hs00159616_m1 |
| PAX4 | Hs00173014_m1 |
| INS | Hs02741908_m1 |
| CXCR4 | Hs00607978_s1 |

Identification of gene combinations that may induce the formation of Pancreatic Progenitor-like cells was investigated by transfection with combinations of FoxD3, Sox17, Pdx1, Ngn3, Mixl1, and MBD2. FoxA2, a marker for Endoderm and Mesoderm, was slightly up-regulated for the FoxD3/Sox17/Ngn3/MBD2-transfected sample as compared to the GFP mock-transfected control sample. Similarly, CXCR4, also a marker for both endoderm and mesoderm, was slightly up-regulated (3-fold compared to GFP-ctrl) for the FoxD3/Mixl1/Ngn3/MBD2-transfected sample. 7 days following transfection, SOX17 can still be detected for the samples transfected with SOX17 at varying levels (4 to 570-fold up-regulation as compared to the GFP-ctrl). The highest SOX17 expression up-regulation is detected for the sample transfected with Sox17/Mixl1/Pdx1/Ngn3 (570-fold as compared to GFP-ctrl), which may suggest that this gene combination may increase the amount of SOX17 RNA in cells.

TABLE 33

Plasmids and media composition from Day 0 to Day 14

| Plasmids transfected at Day 0[1] | Media Composition[2] | | |
|---|---|---|---|
| | Day 0 | Day 1 to Day 3 | Day 4 to Day 14 |
| 1 FoxD3, Sox17, Pdx1, MBD2 | CDM II + Activin A + HSA | DMEM/F12 + NEAA + ITS + HSA + B27 + EGF + bFGF + Activin A + CHIR99021 + Na Butyrate | DMEM/F12 + NEAA + ITS + HSA + B27 + EGF + bFGF + Retinoic Acid + FGF10 + Cyclopamine + Noggin |
| 2 FoxD3, Sox17, Ngn3, MBD2 | | | |
| 3 FoxD3, Mixl1, Pdx1, MBD2 | | | |
| 4 FoxD3, Mixl1, Ngn3, MBD2 | | | |
| 5 Sox17, Mixl1, Pdx1, MBD2 | | | |
| 6 Sox17, Mixl1, Ngn3, MBD2 | | | |
| 7 FoxD3, Sox17, Mixl1, Pdx1 | | DMEM/F12 + NEAA + ITS + HSA + B27 + EGF + bFGF + Activin A + CHIR99021 + Na Butyrate + VPA + 5-Aza | |
| 8 FoxD3, Sox17, Mixl1, Ngn3 | | | |
| 9 FoxD3, Sox17, Pdx1, Ngn3 | | | |
| 10 FoxD3, Mixl1, Pdx1, Ngn3 | | | |
| 11 Sox17, Mixl1, Pdx1, Ngn3 | | | |

[1]where FoxD3 = pCMV6-XL5-FoxD3, Sox17 = pCMV6-XL4-SOX17, Mixl1 = pCMV6-XL5-MIXL1, Pdx1 = pCMV6-XL5-Pdx1, and Ngn3 = pCMV6-XL5-Ngn3. All clones were purchased from Origene and prepared using the EndoFree Plasmid Maxi Kit (Qiagen).
[2]Supplements added to media at the following concentrations: Activin A (Peprotech, 30 ng/ml), HSA (Baxter, 0.5%), NEAA (Gibco, 1X), ITS (Gibco, 1X), B27 (Gibco, 1%), EGF (Peprotech, 5 ng/ml), bFGF (Peprotech, 10 ng/ml), CHIR99021 (Stemgent, 2 uM), Na Butyrate (Stemgent, 1 mM), VPA (Stemgent, 1 mM), 5-Aza (Sigma, 0.5 uM), Retinoic Acid (Sigma, 2 uM), FGF10 (Peprotech, 50 ng/ml), Cyclopamine (Stemgent, 2.5 uM), Noggin (Peprotech, 50 ng/ml)

Example XIX

Reprogramming Human Adipocytes Derived Stem Cells (ADSC) to Pluripotent-Like Stem Cells (PLSC):

ADSCs (Invitrogen Corporation) were cultured in cell culture flasks with complete StemProm™-43 medium (Invitrogen) at 37° C., 5% $CO_2$ and the medium was changed 3 times per week. After 3 days in culture cells (passage 5) were trypsinized and counted to be transfected. Cells were transiently transfected with one plasmid: pCMV6-Oct4-2A-Klf4-2A-Nanog, pCMV-Sall4-2A-Oct4-2A-Klf4-2A-Nanog, pCMV-Dax1-2A-Oct4-2A-klf4, pCMV-FoxD3-2A-Oct4-2A-klf4, pCMV-Oct4-2A-Klf4-2A-Sall4, pCMV-MBD2-2A-Oct4-2A-Klf4-2A, pCMV-AGR2-2A-Oct4-2A-Klf4-2A, or Rex1-EF-Oct4-2A-Klf4 (2 µg); or by two plasmids: pEF-Oct4nuc-IRES2-MBD2 with pCMV-Sox2nuc-IREC-Lin28 or pCMV-Klf4nuc-IRES2-Tpt1nuc or pEF-Stella-IRES2-NPM2, using Nucleofector™ as described in Example II. Following the transfection cells were cultured in 6-well plates in suspension with 50:50 ratio of adipocytes complete medium (StemPro™-43) and embryonic stem cells medium (mTeSR1). After two days in culture, cells were re-transfected with the same plasmids listed above and cells were plated in 96 well-plates coated with Matrigel™ (BD Biosciences) in the presence of mTesR complete medium supplemented with thiazovivin (0.5 µM), an ALK-5 Inhibitor (SB 341542, Stemgent, 2 µM), and inhibitor of MEK (PD0325901, Stemgent, 0.5 µM). Medium was changed every day and cells were cultured for 22 days at 37° C., 5% $CO_2$, 5% $O_2$. Alkaline Phosphatase Detection Kit (AP, Millipore) and immunohistochemistry were performed to analyse the expression of pluripotency markers. ALP staining was performed using AP detection kit (Millipore) according to manufacturer's instructions.

Visual observation of reprogrammed cells was performed by Cellomics™ using a live staining for SSEA-$4_{647}$ (BD Biosciences) and TRA-1-$81_{555}$ (BD Biosciences) starting on Day 6 after transfection and every 5 days thereafter. Reprogrammed colonies of PLSCs, positively stained with SSEA-4 and TRA1-81, was observed only with Plasmid pCMV-Sall4-2A-Oct4-2A-Klf4-2A-Nanog, pEF-Rex1-EF-Oct4-2A-Klf4-2A-RFP, pEF-Oct4nuc-IRES1-MBD2 with pCMV-Sox2nuc-IRES1-Lin28, and pEF-Oct4nuc-IRES1-MBD2 with pCMV-Klf4nuc-IRES2-Tpt1nuc. These colonies emerged around Day 6 and maintained in culture up to the end of the study period (Day 22) with a stable morphology. Among the plasmids cited above, pCMV-Sall4-2A-Oct4-2A-Klf4-Nanog and pEF-Rex1-EF-Oct4-2A-Klf4-2A-RFP gave the highest number of colonies. Live staining showed that these colonies express typical pluripotency markers, including SSEA-4 and TRA1-81, and further analysis of these colonies showed that the colonies also expressed other ESC markers such as alkaline phosphatase and Oct4. When the cultures were treated with PD0325901 and SB431542 for up to 22 days, a 4-fold improvement in efficiency over the conventional method was obtained following the transfection of ADSCs with pCMV-Sall4-2A-Oct4-2A-Klf4-Nanog and pEF-Rex1-EF-Oct4-2A-Klf4-2A-RFP.

Based on the previous study, the highest reprogramming efficiency was observed using pEF-Rex1-EF-Oct4-2A-Klf4-2A-RFP and pCMV-Sall4-2A-Oct4-2A-Klf4-2A-Nanog. Another study was designed to ascertain the effect of pEF-Rex1-EF-Oct4-2A-Klf4-2A-RFP on the reprogramming efficiency and to investigate the effect of individual pluripotent genes Rex1, Oct4, and Klf4 In different combinations. ADSCs were transfected as above with pEF-Rex1-EF-Oct4-2A-Klf4-2A-RFP, pCMV6-XL5-Rex1, pCMV6-XL4-Oct4/pCMV6-XL5-Klf4, pCMV6-XL5-Rex1/pCMV6-XL4-Oct4, or pCMV6-XL5-Rex1/pCMV6-XL5-Klf4. After the second transfection, ADSC were cultured in 96-well plates coated with Matrigel™ for 24 days in the presence of mTeSR1 medium supplemented with SB341542 and PD 0.325901 at 37° C., 5% $CO_2$, 5% O2. In order to characterize subpopulations of cells after transfection, live staining, immunohistochemistry, and AP staining was used to follow the change in pluripotent markers. 1-5% of total cells transfected with Rex1/Oct4 or Rex1/Klf4 showed a SSEA4$^+$ and TRA-1-81$^+$ phenotype, and this pattern was stable until the end of the study period (Day 22). The observation over time showed that the phenotype of these colonies moved from an early SSEA-4$^+$ phenotype to a late Oct4$^+$/Sox2/Nanog$^+$ phenotype by Day 22, which is closer to the final reprogrammed state of a pluripotent-like stem cell.

Various genes were tested for their effect on reprogramming efficiency towards pluripotent-like cells. ADSC cells were cultured as described in Example IX with 2 days VPA and 5-AZA pre-treatment (1 mM and 0.5 µM respectively) in StemPro™ MSC SFM medium. Cells were transfected using the Nucleofector™ 96-well Shuttle® Device (Lonza) following procedure described in Example IV and using the transfection program EW-104 with the DNA mixes described in Table 34. Following transfection the cells were plated in StemPro™ MSC SFM medium described in example A on Matrigel™ (BD Biosciences) coated 24 well plates and incubated at 37° C., 5% $CO_2$, 5% $O_2$. On Day 1, media was changed to a mix of 75% StemPro™ MSC and 25% hES cell medium; the percentage of StemPro™ MSC was decreased every day over four days to have 100% hES cell medium by Day 4. From then onwards the medium was changed every two days. The hES cell medium consisted in Dulbecco's Modified Eagle's Medium (DMEM, Invitrogen) supplemented with 20% Knockout™ Serum Replacement (KSR, Invitrogen), 1 mM GlutaMAX™, 100 µM Non-essential Amino acids, 100 µM β-mercaptoethanol and 10 ng/ml Fgf-2. Different inhibitors and growth factors were added through the course of the experiment; these are listed in Table 34. Cells were analysed at Day 7 and Day 14 by immunohistochemistry analysis and at Day 7 by RT-PCR.

TABLE 34

Plasmids and media composition from Day 1 to Day 14.

| | From day −2 to day 0 | Plasmids transfected at day 0 | From day 1 to day 3 | From day 3 to day 7 | From day 7 to day 14 |
|---|---|---|---|---|---|
| 1 | VPA + 5-Aza pre-treated | pCMV6-XL4-Oct4 + pCMV6-XL5-Sox2 + pCMV6-XL5-MBD2 | StemPro ™/hES medium + ActivinA (30 ng/ml) + CHIR99021 (3 µM) | StemPro ™/hES medium + ActivinA (30 ng/ml) + CHIR99021 (3 µM) | hES medium |
| 2 | VPA + 5-Aza pre-treated | pCMV6-XL4-Oct4 + pCMV6-XL5-FoxD3 + pCMV6-XL5-MBD2 | StemPro ™/hES medium + ActivinA (30 ng/ml) + CHIR99021 (3 µM) | StemPro ™/hES medium + ActivinA (30 ng/ml) + CHIR99021 (3 µM) | hES medium |
| 3 | VPA + 5-Aza pre-treated | pCMV6-XL4-Oct4 + pCMV6-XL5-UTF1 + pCMV6-XL5-MBD2 | StemPro ™/hES medium + ActivinA (30 ng/ml) + CHIR99021 (3 µM) | StemPro ™/hES medium + ActivinA (30 ng/ml) + CHIR99021 (3 µM) | hES medium |
| 4 | VPA + 5-Aza pre-treated | pCMV6-XL4-Oct4 + pCMV6-XL4-DPPA4 + pCMV6-XL5-MBD2 | StemPro ™/hES medium + ActivinA (30 ng/ml) + CHIR99021 (3 µM) | StemPro ™/hES medium + ActivinA (30 ng/ml) + CHIR99021 (3 µM) | hES medium |

TABLE 34-continued

Plasmids and media composition from Day 1 to Day 14.

| | From day −2 to day 0 | Plasmids transfected at day 0 | From day 1 to day 3 | From day 3 to day 7 | From day 7 to day 14 |
|---|---|---|---|---|---|
| 5 | VPA + 5-Aza pre-treated | pCMV6-XL5-Sox2 + pCMV6-XL5-FoxD3 + pCMV6-XL5-MBD2 | StemPro ™/hES medium + ActivinA (30 ng/ml) + CHIR99021 (3 μM) | StemPro ™/hES medium + ActivinA (30 ng/ml) + CHIR99021 (3 μM) | hES medium |
| 6 | VPA + 5-Aza pre-treated | pCMV6-XL5-Sox2 + pCMV6-XL5-UTF1 + pCMV6-XL5-MBD2 | StemPro ™/hES medium + ActivinA (30 ng/ml) + CHIR99021 (3 μM) | StemPro ™/hES medium + ActivinA (30 ng/ml) + CHIR99021 (3 μM) | hES medium |
| 7 | VPA + 5-Aza pre-treated | pCMV6-XL5-Sox2 + pCMV6-XL4-DPPA4 + pCMV6-XL5-MBD2 | StemPro ™/hES medium + ActivinA (30 ng/ml) + CHIR99021 (3 μM) | StemPro ™/hES medium + ActivinA (30 ng/ml) + CHIR99021 (3 μM) | hES medium |
| 8 | VPA + 5-Aza pre-treated | pCMV6-XL5-FoxD3 + pCMV6-XL5-UTF1 + pCMV6-XL5-MBD2 | StemPro ™/hES medium + ActivinA (30 ng/ml) + CHIR99021 (3 μM) | StemPro ™/hES medium + ActivinA (30 ng/ml) + CHIR99021 (3 μM) | hES medium |
| 9 | VPA + 5-Aza pre-treated | pCMV6-XL5-FoxD3 + pCMV6-XL4-DPPA4 + pCMV6-XL5-MBD2 | StemPro ™/hES medium + ActivinA (30 ng/ml) + CHIR99021 (3 μM) | StemPro ™/hES medium + ActivinA (30 ng/ml) + CHIR99021 (3 μM) | hES medium |
| 10 | VPA + 5-Aza pre-treated | pCMV6-XL5-UTF1 + pCMV6-XL4-DPPA4 + pCMV6-XL5-MBD2 | StemPro ™/hES medium + ActivinA (30 ng/ml) + CHIR99021 (3 μM) | StemPro ™/hES medium + ActivinA (30 ng/ml) + CHIR99021 (3 μM) | hES medium |
| 11 | VPA + 5-Aza pre-treated | pCMV6-XL4-Oct4 + pCMV6-XL5-Sox2 + pCMV6-XL5-FoxD3 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 12 | VPA + 5-Aza pre-treated | pCMV6-XL4-Oct4 + pCMV6-XL5-Sox2 + pCMV6-XL5-UTF1 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 13 | VPA + 5-Aza pre-treated | pCMV6-XL4-Oct4 + pCMV6-XL5-Sox2 + pCMV6-XL4-DPPA4 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 14 | VPA + 5-Aza pre-treated | pCMV6-XL4-Oct4 + pCMV6-XL5-FoxD3 + pCMV6-XL5-UTF1 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 15 | VPA + 5-Aza pre-treated | pCMV6-XL4-Oct4 + pCMV6-XL5-FoxD3 + pCMV6-XL4-DPPA4 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 16 | VPA + 5-Aza pre-treated | pCMV6-XL4-Oct4 + pCMV6-XL5-UTF1 + pCMV6-XL4-DPPA4 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 17 | VPA + 5-Aza pre-treated | pCMV6-XL5-Sox2 + pCMV6-XL5-FoxD3 + pCMV6-XL5-UTF1 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 18 | VPA + 5-Aza pre-treated | pCMV6-XL5-Sox2 + pCMV6-XL5-FoxD3 + pCMV6-XL4-DPPA4 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 19 | VPA + 5-Aza pre-treated | pCMV6-XL5-Sox2 + pCMV6-XL5-UTF1 + pCMV6-XL4-DPPA4 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |
| 20 | VPA + 5-Aza pre-treated | pCMV6-XL5-FoxD3 + pCMV6-XL5-UTF1 + pCMV6-XL4-DPPA4 | StemPro ™/hES medium + ActivinA (30 ng/ml) + CHIR99021 (3 μM) + VPA + 5-Aza | StemPro ™/hES medium + ActivinA (30 ng/ml) + CHIR99021 (3 μM) | hES medium |

TABLE 34-continued

Plasmids and media composition from Day 1 to Day 14.

| | From day −2 to day 0 | Plasmids transfected at day 0 | From day 1 to day 3 | From day 3 to day 7 | From day 7 to day 14 |
|---|---|---|---|---|---|
| 21 | VPA + 5-Aza pre-treated | GFP | StemPro ™/hES medium + ActivinA (30 ng/ml) + CHIR99021 (3 μM) +/or − VPA + 5-Aza | StemPro ™/hES medium + ActivinA (30 ng/ml) + CHIR99021 (3 μM) | hES medium |

In order to characterize subpopulations of cells after transfection, live staining, immunohistochemistry, and AP staining was performed to follow the change in pluripotent markers. Cells transfected with either Oct4/UTF1/MBD2, Oct4/Dppa4/MBD2, FoxD3/Dppa4/MBD2, Oct4/FoxD3/Dppa4, or Sox2/FoxD3/UTF1 showed positive colonies for TRA1-60, TRA1-81, and SSEA4. This observation indicated that MBD2 generally had no effect by itself on reprogramming towards pluripotent-like cells, except in the case of Oct4/FoxD3/MBD2 transfection. Colonies started to form on Day 7 and continued to form until Day 14 (the end of the study period). These colonies were positive for AP as well.

These results were confirmed by RT-PCR analysis showing up-regulation of Oct4 expression as shown in Table 35. Relative expression for SOX2 w as also slightly up-regulation in Day 7 after transfecting cells with Oct4/Foxd3/MBD2. There is also a trend of Sox2 up-regulation following transfection with Oct4/Sox2/Foxd3 and Oct4/Foxd3/Utf1.

TABLE 35

Relative expression of Pluripotent genes after transfecting ADSCs with various combinations of vectors as described in Table 34.

| | OCT4 | | Endogenous SOX2 | |
|---|---|---|---|---|
| | Rel. Exp. | Std. Dev. | Rel. Exp. | Std. Dev. |
| #1 Day 7, Oct4/Sox2/MBD2 | 25.20 | 1.89 | 3.89 | 2.06 |
| #2 Day 7, Oct4/Foxd3/MBD2 | 11.28 | 0.13 | 18.79 | 0.03 |
| #3 Day 7, Oct4/Utf1/MBD2 | 2.01 | 0.20 | 2.93 | 1.73 |
| #4 Day 7, Oct4/Dppa4/MBD2 | 9.68 | 1.36 | 1.18 | 0.15 |
| #5 Day 7, Sox2/Foxd3/MBD2 | 1.06 | 0.55 | 2.68 | 2.90 |
| #6 Day 7, Sox2/Utf1/MBD2 | 0.66 | 0.10 | 3.36 | 0.68 |
| #7 Day 7, Sox2/Dppa4/MBD2 | 0.74 | 0.00 | 5.03 | 4.73 |
| #8 Day 7, Foxd3/Utf1/MBD2 | 1.31 | 0.61 | 4.15 | 2.92 |
| #9 Day 7, Foxd3/Dppa4/MBD2 | 0.63 | 0.02 | 3.90 | 2.17 |
| #10 Day 7, Utf1/Dppa4/MBD2 | 0.96 | 0.04 | 4.97 | 1.92 |
| #11 Day 7, Oct4/Sox2/Foxd3 | 48.17 | 1.89 | 7.68 | 1.79 |
| #12 Day 7, Oct4/Sox2/Utf1 | 48.97 | 6.93 | 3.71 | 0.39 |
| #13 Day 7, Oct4/Sox2/Dppa4 | 32.40 | 2.74 | 4.61 | 2.37 |
| #14 Day 7, Oct4/Foxd3/Utf1 | 4.30 | 0.91 | 9.83 | 3.03 |
| #15 Day 7, Oct4/Foxd3/Dppa4 | 4.21 | 0.11 | 4.57 | 0.85 |
| #16 Day 7, Oct4/Utf1/Dppa4 | 10.29 | 3.70 | 3.53 | 1.63 |
| #17 Day 7, Sox2/Foxd3/Utf1 | 1.42 | 0.83 | 3.32 | 2.12 |
| #18 Day 7, Sox2/Foxd3/Dppa4 | 1.19 | 0.14 | 3.37 | 1.23 |
| #19 Day 7, Sox2/Utf1/Dppa4 | 1.34 | 0.09 | 2.33 | 2.91 |
| #20 Day 7, Foxd3/Utf1/Dppa4 | 0.72 | 0.07 | 2.45 | 0.27 |
| #21 Day 7, GFP (−VPA/−5aza) | 1.02 | 0.29 | 1.01 | 0.17 |
| #22 Day 7, Untransf. ADSC (−VPA/−5aza) | 1.25 | N/A | 0.30 | N/A |
| #23 Day 7, GFP (+VPA/+5aza) | 1.01 | 0.20 | 1.87 | 2.23 |
| #24 Day 7, Untransf. ADSC (+VPA/+5aza) | 1.45 | N/A | 0.27 | N/A |

Reprogramming Efficiency of Defined Pluripotency Factors on HFF after Triple Transfection (One Transfection Every 3 Days)

HFF cells were cultured as described in Example I with the exception of the concentrations of VPA and 5-AZA that were respectively 2 mM and 2.5 μM. Cells were transfected using the Nucleofector™ II Device (Lonza) following procedure described in Example II with the exception of the DNA quantity: 1 μg of each of the 3 plasmids DNA was used. The cells that had been pre-treated with VPA and 5-Aza and the untreated cells were both transfected with a mix of pCMV-Oct4nuc-IRES2-Sox2nuc, pCMV-Klf4nuc-IRES2-Cmycnuc or pCMV-Nanognuc-IRES2-Lin28. Following transfection the cells were plated in the fibroblasts medium described in Example I, supplemented with or without VPA and 5-AZA on Matrigel™ (BDBiosciences) coated on 6-well plates and incubated at 37° C., 5% $CO_2$. On Day 1 and 2, media was changed to 100% mTeSR1 medium (StemCell Technologies) supplemented with or without VPA and 5-AZA. On Day 3 and Day 6, cells from each condition were detached by incubation in TrypLE™ for 5 min, counted and centrifuged. Cells were retransfected as above and plated on Matrigel™ coated plates in mTeSR1 medium supplemented with or without VPA and 5-AZA. Media was changed daily as described for day 1 and 2. Medium was supplemented in Y27632 (Stemgent, 10 μM) from day 7 to day 14 to promote viability and clonal expansion of potential reprogrammed cells. Cells were analysed at Day 20 using the Alkaline Phosphatase Detection Kit (Millipore) and by immunohistochemistry analysis.

This analysis revealed that after three transfections, three clones were found to be positive for alkaline phosphatase activity and showed a rounded cell/colony morphology. Staining with antibodies against the embryonic stem (ES) cell markers SSEA-4 and TRA-1-81 confirmed that these clones were pluripotent-like. Surrounding HFF cells were negative for these markers. These clones were obtained only in the condition that did not contain inhibitors (i.e.: VPA and 5-AZA). Unexpectedly, no clones were observed for the condition treated with these inhibitors.

Reprogramming of NSLCs into Pluripotency

NSLC and neuronal stem cells derived from BG-01, a human ES cell line that expresses markers that are characteristic of ES cells including SSEA-3, SSEA-4, TRA-1-60, TRA-1-81, and OCT-3/4, were reprogrammed into pluripotency. BG-01 cells had previously been cultured in conditions to induce the differentiation towards neural stem cells as described by Chambers S M et al., 2009. NSLCs and BG-01-NSC were cultured in proliferation medium supplemented with FGF (20 ng/ml) and EGF (20 ng/ml). NSLCs and BG-01-NSCs were transfected as previously described in Example II by two episomal vectors, pEF-Oct4nuc-IRES2-MBD2 (NC1) or pCMV-FoxD3-2A-Oct4-2A-Klf4 (F72). Following transfection cells were collected and plated onto uncoated petri-dishes in the presence of Proliferation medium and mTeSR1 medium (50:50) in proliferation conditions at 37° C., 5% CO2. After 48 hours, cells were re-transfected by the same plasmid and plated in 96-well plates coated with Matrigel™ and cultured in the presence of mTeSR1 medium supplemented by the small molecules BIX01294 (Stemgent, 2 μM) and BayK8644 (Stemgent, 2 μM) at 37° C., 5% $O_2$ for 22 days. Live staining and immunohistochemistry were performed to characterize subpopulations of cells for pluripotency markers.

NSLCs and BG-01-NSCs were positively stained with SSEA-4 starting on Day 7 and maintained until 22 days in culture (the end of the study). Within ten days, cells that were morphologically similar to ESCs were observed and they expressed a wide panel of pluripotency markers, including SSEA-4, TRA1-81, Nanog and Oct4. This study identified another way to get pluripotent-like cells from somatic cells via Neural Stem-Like Cells (NSLCs). The utility of NSLCs could offer multiple advantages for reprogramming towards pluripotent-like cells. For example, obviating the requirement for tumorigenic genes like c-Myc reduces the risk of inducing cancerous cells. For neuroregenerative and neurodegenerative applications these cells could represent an invaluable source of cells to investigate furthermore human pluripotent cell induction, and also represent a potential source of cells for deriving patient-specific multipotent and pluripotent stem cells for modeling human disease.

Example XX

Teratoma Formation Assay in SCID Mice

Transplantation of human pluripotent stem cells (SC) into "severely compromised immuno-deficient" (SCID) mice leads to the formation of differentiated tumors comprising all three germ layers for pluripotent stem cells, resembling spontaneous human teratomas, and specialized tissue for multipotent stem cells. These assays are considered the standards in the literature for demonstrating differentiation potential of pluripotent stem cells and hold promise as a standard for assessing safety among SC-derived cell populations intended for therapeutic applications After all appropriate animal approvals for the experiment has been obtained, 24 mice were purchased from Charles Rivers, and housed at MISPRO animal facility for one week without any experimentation for adaptation to the new environment. One million human NSLCs, normal human neuroprogenitor cells (hNPCs), or human embryonic stem (ES) cells in 100 μl Phosphate buffered saline, calcium- and magnesium-free (CMF-PBS) were injected with a 21-G needle intramuscularly into the right hind limb of the 4-week-old male SCID-beige mice under anesthesia with Ketamine/xylazine (8 mice per group). Following injection, the syringe was aspirated up and down a couple of times in a culture dish containing medium to verify that the cells were injected and not stuck inside the syringe.

The mice were maintained for 12 weeks and monitored for clinical signs and any tumor growth regularly. Any specialized tissue or teratoma growth was monitored by external examination and an increase in the size of the muscle relative to the same muscle on the left hind limb. When a specialized tissue or teratoma was identified, the location and size of the growth was measured (using measuring calipers) and recorded. The specialized tissue or teratoma is usually first identified as a small growth of the muscle size compared to the left control muscle. Animals were monitored weekly until onset of any tumor growth, and daily after tumors appeared. After 12 weeks, the mice were sacrificed by $CO_2$ euthanasia. Each entire animal was observed for any tumor growth anywhere on the animal, and the injected muscle and the comparable left muscle control were measured (with measuring calipers) (see results table below) and then removed and stored in 4% paraformaldehyde solution for histological analysis. The sizes of the muscles were as follows:

| Treatment | Left leg (control) | | Right leg (treated) | |
| --- | --- | --- | --- | --- |
| | Dorso-ventral width | Lateral width | Dorso-ventral width | Lateral width |
| Human Embryonic Stem Cells | 6.44 ± 0.11 | 5.03 ± 0.17 | 6.91 ± 0.15 | 5.3 ± 0.14 |
| Human Neuroprogenitor Cells | 6.60 ± 0.17 | 5.43 ± 0.15 | 7.01 ± 0.23 | 5.58 ± 0.13 |
| Human NSLC | 6.85 ± 0.2 | 5.32 ± 0.14 | 6.86 ± 0.21 | 5.33 ± 0.11 |

Values represent the Average of 8 mice ± the standard error

Measurement of the size of the muscles revealed that all the human embryonic stem cell injected muscles were bigger than the comparable left muscle controls, Indicating teratoma growth in the ES cell injected muscles. About half of all the human neuroprogenitor cell injected muscles were bigger than the comparable left muscle controls, while the mice injected with NSLC did not show any difference between the muscles (treated with the cells or not). The mice injected with NSLC did not show any evidence of tumor or teratoma growth.

Example XXI: Transfection of ADSCs by Various Combinations of Genes and Treatment with Small Molecules for Reprogramming to Mesendoderm-Like Cells Human Adipose-Derived Stem Cells (ADSCs) were purchased from Invitrogen and expanded in complete StemPro™ MSC serum-free medium (Invitrogen on. CellStart™ coated flasks (diluted 1:100 In PBS containing $Ca^{2+}/Mg^{2+}$) at a cell density of $1\times10^4$ cells/$cm^2$. ADSCs were cultured as described in complete StemPro medium (Invitrogen) and were pretreated for 2 days prior to transfection with VPA (1 mM) and 5-Aza (0.5 μM). Cells were transfected using the Nucleofector™ 96-well Shuttle™ Device (Lonza) following the procedure described previously. The cells were transfected with various combinations of cDNA clones summarized in Table 36. After transfection, the cells were plated on 0.1% Gelatin-coated plates and incubated at 37° C., 5% $CO_2$, 5% $O_2$. Medium was changed every other day according to Table 37. Cells were analyzed at Day 10 by Quantitative Real-time PCR.

TABLE 36

Various combinations of plasmids with potential to transfect the cells towards mesendoderm lineage.

| | Day −2 to Day 0 | Plasmids transfected at Day 0[1] |
|---|---|---|
| 1 | Untreated | FoxD3, Ngn3, Sox17, MBD2 |
| 2 | | FoxD3, Eomes, Gata6, Mixl1, MBD2 |
| 3 | Pre-treated with VPA & 5-Aza | Eomes, FoxD3, Gata6, Mixl1 |
| 4 | | Eomes, FoxD3, Gata6, Sox17 |
| 5 | | Eomes, Gata6, Mixl1, T |
| 6 | | FoxD3, Gata4, Mixl1, Sox17 |
| 7 | | Gata4, Gata 6, Mixl1, Oct4 |
| 8 | | Gata4, Mixl1, Sox17, T |
| 9 | | Eomes, Mixl1, Sox17 |
| 10 | | Eomes, Gata6, Sox17 |
| 11 | | Gata4, Mixl1, Sox17 |
| 12 | | Gata6, Mixl1, Sox17 |
| 13 | | GFP |

[1] where FoxD3 = pCMV6-XL5-FoxD3, MBD2 = pCMV6-AC-MBD2, T = pCMV6-XL5-T, Mixl1 = pCMV6-XL5-Mixl1, Sox17 = pCMV6-XL4-SOX17, Gata4 = pCMV6-XL5-Gata4, Eomes = pCMV6-XL4-Eomes, and Gata6 = pCMV6-XL6-Gata6. All clones were purchased from Origene and prepared using the EndoFree Plasmid Maxi Kit (Qiagen).

TABLE 37

Medium composition from Day −2 to Day 20

| Day −2 to 0 | Day 1 | Day 2 to day 3 | Day 4 to day 7 | Day 8 to day 10 | Day 11 to day 20 |
|---|---|---|---|---|---|
| StemPro medium + VPA + 5Aza | CDM II (50%) + IMDM/F12 (50%) + NEAA + ITS + HSA + bFGF + EGF + VPA + Activin A + 5-Aza | IMDM/F12 + NEAA + ITS + HSA + bFGF + EGF + VPA + Activin A + 5-Aza + BMP4 | IMDM/F12 + NEAA + ITS + HSA + bFGF + EGF + Activin A + 5-Aza + BMP4 | IMDM/F12 + NEAA + ITS + HAS + bFGF + EGF + BMP4 | IMDM/F12 + NEAA + ITS + HSA + Exendin-4, nicotinamide |

[2] Supplements added to media at the following concentrations: Activin A (Peprotech, 30 ng/ml), HSA (Baxter, 0.5%), NEAA (Gibco, 1X), ITS (Gibco, 1X), EGF (Peprotech, 5 ng/ml), bFGF (Peprotech, 10 ng/ml), VPA (Stemgent, 1 mM), 5-Aza (Sigma, 0.5 uM), BMP4 (Peprotech, 10 ng/ml), Exendin-4 (50 ng/ml, Cat Nb: 24463, Anaspec), and Nicotinamide (10 mM final, Cat Nb: N5535, Sigma).

Cells were collected on Day 10 by detaching with TrypLE, followed by centrifugation at 80×g for 5 minutes. Supernatant was aspirated and the cell pellet was frozen at −86° C. until ready for RNA Isolation. RNA isolation and quantification was performed as previously described: RNA isolation and cDNA was prepared using the High Capacity cDNA RT kit (Applied Biosystems) as per the manufacturer's instructions with a final cDNA concentration of 2 ng/μl. Real-time PCR was then performed for each gene of Interest using the FAST PCR master mix (Applied Biosystems) and the Taqman® Gene Expression Assays (Applied Biosystems) listed below:

| Gene | Taqman® Assay ID | Forward Primer Sequence | Reverse Primer Sequence | Probe Sequence |
|---|---|---|---|---|
| GAPDH (housekeeper) | Hs99999905_m1 | | | |
| PPIA (housekeeper) | Hs99999904_m1 | | | |
| FOXA2 | Hs00232764_m1 | | | |
| SOX17 | Hs00751752_s1 | | | |
| Endogenous T | Hs00610073_g1 | | | |
| GSC | Hs00418279_m1 | | | |
| CXCR4 | Hs00607978_s1 | | | |
| GATA4 | Hs00171403_m1 | | | |
| CER1 | Hs00193796_m1 | | | |
| CDH1 (E-cadherin) | Hs01023894_m1 | | | |
| p63 | Hs00978340_m1 | | | |
| SOX2 | SOX2_1078-ANY | CCACCTACA GCATGTCCT ACTC | GACCACC GAACCCA TGGA | CTGGCAT GGCTCTTG (SEQ ID NO: 510) |
| | | (SEQ ID NO: 510) | (SEQ ID NO: 511) | (SEQ ID NO: 512) |

Ten days following the transfection with various combinations of Oct4, Sox17, FoxD3, T, Mixl1, FoxA2, and MBD2 cDNA, analysis by RT-PCR to investigate the expression of Mesoendoderm and mesendoderm differentiation genes was performed. As summarized in Table 38, the Relative Expression of Sox17 and FoxA2, the markers for Endoderm and Mesoderm, was up-regulated noticeably in the FoxD3/Mixl1/Ngn3/MBD2-transfected sample, while the expression of mesendoderm differentiation (ex. pancreatic lineage) genes are low indicating an early mesendoderm phenotype. Ten days following transfection, SOX17 is still highly expressed in the SOX17-transfected samples as compared to the untreated ADCs sample that represents leftover plasmid DNA (exogenous SOX17) that still remains 10 days post-transfection, and any endogenous SOX17 expression that may have been induced.

TABLE 38

Relative Expression of the mesendoderm genes FoxA2 and Sox17 after transfecting ADSCs once with various gene combinations with potential to reprogram cells into mesoendoderm-like cells.

| | FoxA2 | | Sox17 | | Gata4 | | EndoPdX1 | | Sox9 | | Ngn3 | | Nkx2.2 | | Insulin | |
|---|---|---|---|---|---|---|---|---|---|---|---|---|---|---|---|---|
| Day 10 | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| Foxd3/Sox17/Ngn3/MBD2 | 1.13 | 0.06 | 44.41 | 0.51 | 0.16 | 0.11 | 1.13 | 0.06 | 0.98 | 0.05 | 1.13 | 0.06 | 1.13 | 0.06 | 1.13 | 0.06 |
| Foxd3/Mixl1/Ngn3/MBD2 | 48.03 | 2.28 | 11.17 | 0.58 | 0.08 | 0.00 | 1.71 | 0.79 | 0.97 | 0.08 | 1.13 | 0.04 | 1.51 | 0.51 | 1.13 | 0.04 |
| Foxd3/Mixl1/Pdx1/MBD2 | 2.36 | 1.68 | 0.33 | 0.07 | 0.08 | 0.00 | 1.19 | 0.03 | 1.24 | 0.08 | 1.19 | 0.03 | 1.19 | 0.03 | 1.66 | 0.63 |
| Eomes/FoxD3/Gata6/Mixl1 | 3.12 | 0.06 | 0.05 | 0.00 | 0.22 | 0.00 | 3.12 | 0.06 | 1.87 | 0.02 | 3.12 | 0.06 | 3.12 | 0.06 | 3.12 | 0.06 |
| Eomes/FoxD3/Gata6/Sox17 | 2.64 | 0.01 | 137.24 | 12.01 | 0.71 | 0.70 | 2.64 | 0.01 | 1.73 | 0.02 | 2.64 | 0.01 | 2.64 | 0.01 | 2.64 | 0.01 |
| Eomes/Gata6/Mixl1/T | 1.51 | 0.02 | 1.37 | 0.05 | 0.11 | 0.00 | 1.51 | 0.02 | 1.46 | 0.03 | 1.51 | 0.02 | 1.51 | 0.02 | 1.51 | 0.02 |
| FoxD3/Gata4/Mixl1/Sox17 | 0.78 | 0.00 | 84.72 | 3.22 | 0.21 | 0.00 | 0.78 | 0.00 | 1.19 | 0.12 | 0.55 | 0.00 | 0.78 | 0.00 | 0.26 | 0.00 |
| Gata4/Gata6/Mixl1/oct4 | 1.35 | 0.04 | 3.20 | 1.20 | 0.36 | 0.01 | 1.35 | 0.04 | 1.33 | 0.10 | 0.95 | 0.03 | 1.35 | 0.04 | 0.45 | 0.01 |
| Gata/Mixl1/Sox17/T | 1.20 | 0.21 | 228.37 | 5.78 | 1.48 | 0.93 | 0.41 | 0.00 | 0.62 | 0.02 | 0.29 | 0.00 | 0.41 | 0.00 | 0.14 | 0.00 |
| Eomes/Mixl1/Sox17 | 1.72 | 1.41 | 139.00 | 7.36 | 0.20 | 0.01 | 0.76 | 0.05 | 1.21 | 0.03 | 0.54 | 0.04 | 0.76 | 0.05 | 0.44 | 0.28 |
| Eomes/Gata6/Sox17 | 0.57 | 0.03 | 573.14 | 65.66 | 0.15 | 0.01 | 0.93 | 0.49 | 0.97 | 0.05 | 0.40 | 0.02 | 1.55 | 1.38 | 0.19 | 0.01 |
| Gata4/Mixl1/Sox17 | 1.23 | 0.02 | 253.21 | 45.51 | 123.32 | 62.32 | 1.52 | 0.21 | 2.32 | 0.04 | 0.58 | 0.01 | 2.25 | 0.65 | 0.98 | 0.01 |
| Gata6/Mixl1/Sox17 | 1.20 | 0.32 | 354.21 | 7.65 | 0.32 | 0.01 | 1.52 | 0.52 | 1.23 | 0.05 | 0.98 | 0.12 | 2.32 | 0.54 | 0.78 | 0.08 |
| ADCs untransf. | 0.49 | 0.02 | 0.93 | 0.19 | 0.49 | 0.48 | 0.49 | 0.02 | 1.16 | 0.08 | 0.34 | 0.01 | 0.73 | 0.33 | 0.16 | 0.01 |

Example XXII: Transfection of ADSCs by Various Combinations of Genes and Treatment with Small Molecules for Reprogramming to Pancreatic Progenitor-Like Cells Reprogramming ADSCs into Pancreatic Progenitor-Like Cells: Human ADSCs were purchased from Invitrogen and expanded in complete StemPro™ MSC serum-free medium (Invitrogen on CellStart™ coated flasks (diluted 1:100 in PBS containing $Ca^{2+}/Mg^{2+}$) at a cell density of $1 \times 10^4$ cells/cm$^2$. Cells were transfected using the Nucleofector® 96-well Shuttle® Device (Lonza) following the procedure described previously. The cells were transfected with various combinations of cDNA clones as described in Table 4.

After transfection, the cells were plated on Fibronectin-coated collagen gels and incubated at 37° C., 5% $CO_2$, 5% $O_2$. Plates were coated with fibronectin (BD Biosciences) at a concentration of 1.9 µg/well. Media was changed every other day according to Table 39. Following transfection cells will be cultured using high concentration of activin A (50 ng/ml) and BMP (30 ng/ml) to push the reprogramming towards the mesendoderm. To initiate the transition of definitive endoderm to Primitive Gut tube, the medium was supplemented by FGF 10 (Peprotech) and cyclopamine (Stemgent). Thereafter, the gut tube was exposed to Retinoic acid, cyclopamine, and FGF10. In order to stimulate the expression of NGN3 and NKx2.2, the medium was supplemented by exendin 4 and hepatocyte growth factor.

TABLE 39

Plasmids and media composition from Day 0 to Day 20
Media Composition[1]

| Plasmids transfected at Day 0 | Day −2 to Day 0 | Day 1 to 3 | Day 3 to 6 | Day 7 to 9 | Day 10 to 14 | Day 15 and over |
|---|---|---|---|---|---|---|
| 1 - MBD2/Oct4/Sox17 | StemPro medium | StemPro/RPMI with 17.5 mM glucose, ITS, 1 mM glutamine, 1% HSA + Activin A (50 ng/ml) + BMP4 (30 ng/ml) | RPMI, B27 1%. With 1 mM glutamine, 1% HSA + FGF 10 (10 ng/ml) | DMEM free of glucose/F12 (1:1) + B27 1%, 1% HSA, Retinoic acid (2 nM) Cyclopamine (10 mM), FGF10 (10 ng/ml) | DMEM free of glucose/F12 (1:1) + B27 1%, 1% HSA, Exendin4 (10 nM) & Cyclopamine (10 mM), | DMEM/F12 nicotinamide (10 nM), + Hepatocyte growth factor (20 ng/ml) & exendin4 (10 nM) |
| 2 - MBD2/Oct4/Pdx1 | | | | | | |
| 3 - Sox17/PDX1/Ngn3 | | | | | | |
| 4 - MBD2/Ngn3/Sox17 | | | | | | |
| 5 - MBD2/FoxA2/NGN3 | | | | | | |
| 6 - MBD2/PDX1/Ngn3 | | | | | | |
| 7 - Oct4/Sox17/Pdx1/Ngn3 | | | | | | |
| 8 - Oct4/Pdx1/Ngn3 | | | | | | |
| 9 - FoxA2/Pdx1/Sox17 | | | | | | |
| 10 - GFP | | | | | | |

[1]Supplements added to media at the following concentrations: Activin A (Peprotech, 30 ng/ml), HSA (Baxter, 0.5%), NEAA (Gibco, 1X), ITS (Gibco, 1X), B27 (Gibco, 1%), bFGF (Peprotech, 10 ng/ml),,, VPA (Stemgent, 1 mM), 5-Aza (Sigma, 0.5uM), Retinoic Acid (Sigma, 2uM), FGF10 (Peprotech, 50 ng/ml), Cyclopamine (Stemgent, 2.5uM), Exendin-4 (50 ng/ml, Cat Nb:24463, Anaspec).

Cells were collected on Day 20 to be analyzed by Quantitative Real-time PCR and RNA Isolation and quantification was performed as described previously. cDNA was prepared and quantitative real-time PCR was performed with the following Taqman® Gene Expression Assays (Applied Biosystems) used:

were up-regulated for the Sox17/Ngn3/Pdx1-transfected sample as compared to the GFP mock-transfected control sample. Addition of Oct4 to this gene combination increased Gata4 expression as well as Sox17 and endogenous Pdx1 expression, while both gene combinations expressed insulin indicative of islet ß-like cells.

TABLE 40

Relative Expression of mesendoderm, pancreatic progenitor, and islet β-cell genes after transfecting ADSCs once with various gene combinations with potential to reprogram cells into pancreatic progenitor like cells (including mesoendoderm-like cells and islet β-like cells).

| Day 20 | FoxA2 | | Sox17 | | Gata4 | | EndoPdx1 | | Sox9 | | Ngn3 | | Nkx2.2 | | Insulin | |
|---|---|---|---|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| MBD2/Oct4/Sox17 | 1.13 | 0.06 | 62.97 | 27.53 | 0.16 | 0.11 | 1.13 | 0.06 | 0.98 | 0.05 | 1.13 | 0.06 | 1.13 | 0.06 | 1.13 | 0.06 |
| MBD2/Oct4/Pdx1 | 4.72 | 3.36 | 10.59 | 0.29 | 0.08 | 0.00 | 15.91 | 0.03 | 0.97 | 0.08 | 1.13 | 0.04 | 1.51 | 0.51 | 1.13 | 0.04 |
| MBD2/FoxA2/PDX1 | 43.16 | 6.34 | 0.33 | 0.07 | 0.08 | 0.00 | 14.69 | 2.26 | 1.24 | 0.08 | 1.19 | 0.03 | 1.19 | 0.03 | 1.66 | 0.63 |
| Sox17/PDX1/Ngn3 | 13.12 | 0.06 | 72.37 | 27.67 | 5.21 | 2.38 | 32.08 | 14.55 | 1.87 | 0.02 | 97.04 | 18.77 | 23.12 | 0.06 | 6.12 | 0.06 |
| MBD2/Ngn3/Sox17 | 2.64 | 0.01 | 137.24 | 12.01 | 0.71 | 0.07 | 2.64 | 0.01 | 1.73 | 0.02 | 12.58 | 3.08 | 2.64 | 0.01 | 2.64 | 0.01 |
| MBD2/FoxA2/NGN3 | 72.59 | 0.02 | 10.22 | 0.14 | 0.11 | 0.00 | 1.51 | 0.02 | 1.46 | 0.03 | 20.33 | 5.17 | 1.51 | 0.02 | 1.51 | 0.02 |
| MBD2/PDX1/Ngn3 | 0.78 | 0.00 | 42.36 | 1.61 | 0.21 | 0.00 | 20.07 | 6.32 | 1.19 | 0.12 | 59.24 | 14.07 | 0.78 | 0.00 | 0.26 | 0.00 |
| Oct4/Sox17/Pdx1/Ngn3 | 11.35 | 0.04 | 139.00 | 7.36 | 34.53 | 17.18 | 116.68 | 41.77 | 1.33 | 0.10 | 121.30 | 4.76 | 5.35 | 0.04 | 6.07 | 0.06 |
| Oct4/Pdx1/Ngn3 | 1.72 | 1.41 | 1.33 | 0.36 | 9.85 | 5.24 | 67.42 | 34.45 | 1.21 | 0.03 | 34.50 | 2.38 | 0.76 | 0.05 | 1.44 | 0.28 |
| FoxA2/Pdx1/Sox17 | 100.57 | 0.03 | 143.29 | 16.42 | 0.15 | 0.01 | 13.19 | 4.24 | 0.97 | 0.05 | 0.40 | 0.02 | 1.55 | 1.38 | 0.19 | 0.01 |
| ADSC untransf. | 0.04 | 0.01 | 0.21 | 0.08 | 0.08 | 0.00 | 1.16 | 0.01 | 1.02 | 0.13 | 1.16 | 0.01 | 1.71 | 0.77 | 1.16 | 0.01 |

| Gene | Taqman ® Assay ID | Forward Primer Sequence | Reverse Primer Sequence | Probe Sequence |
|---|---|---|---|---|
| GAPDH (housekeeper) | Hs99999905_m1 | | | |
| PPIA (housekeeper) | Hs99999904_m1 | | | |
| FOXA2 | Hs00232764_m1 | | | |
| SOX17 | Hs00751752_s1 | | | |
| GATA4 | Hs00171403_m1 | | | |
| Endogenous PDX1 | PDX1_1201 | GGCCCTCTTTT AGTGATACTG GATT (SEQ ID NO: 513) | GTAGGAGGGCACAGCCA AGGGATGTG (SEQ ID NO: 514) | CAAACAA CG (SEQ ID NO: 515) |
| SOX9 | Hs00165814_m1 | | | |
| NGN3 | Hs01875204_s1 | | | |
| NKX2-2 | Hs00159616_m1 | | | |
| PAX4 | Hs00173014_m1 | | | |
| INS | Hs02741908_m1 | | | |
| CXCR4 | Hs00607978_s1 | | | |

RT-PCR was used to evaluate the expression of pancreatic-related genes from cells after 20 days post-transfection with different combinations of genes (Table 40). This study revealed that FoxA2 (13.12±0.06), Nkx2.2 (23.12±0.06) and Gata4 (5.21±2.36), markers for Endoderm and Mesoderm, Next immunohistochemical analysis was performed to evaluate protein expression in cells transfecting with the different gene combinations. On day 20, the cells were immunostained and examined using the Cellomics™ ArrayScan VTI. Cells were fixed with a 4% formaldehyde/PBS solution for 10 min at room temperature and subsequently permeabilized for 5 min with 0.1% Triton X-100 in 4% formaldehyde/PBS. After two brief washes with PBS, unspecific antibody binding was blocked by a 30 min incubation with 5% normal goat serum in PBS. Then primary antibodies were added in 5% normal goat serum/PBS as follows: Mouse anti-Gata4 (1:100, BD) and mouse anti-FoxA2 (1:200, BD), a marker for endoderm layer. After a 2 h incubation the cells were washed 4 times for 5 min each with 0.1% Tween/PBS. Appropriate fluorescence-tagged secondary antibody was used for visualization; Goat anti-mouse 546 (1:200, invitrogen) prepared in 5% normal goat serum/PBS was used. After incubation for one hour, cells were washed in 0.1% Tween/PBS three times for 5 min each. The DNA stain Hoechst33342 (Invitrogen) was used as a marker of nuclei (dilution 1:5000 in PBS, 10 min incubation). Fluorescence images were taken with the Cellomics™ ArrayScan HCS Reader microscopy system. To determine an estimate of the percentage of cells adopting endodermal phenotypes, random fields were selected and for each field the total number of cells (as determined by counting Hoechst stained nuclei) and the total number of cells positive were determined. The cells in the Sox17/Pdx1/Ngn3 and Oct4/Sox17/Pdx1/Ngn3 transfected groups significantly expressed both Gata4 and FoxA2: the number of positive cells was enhanced in the presence of Oct4 as shown in Table 41.

TABLE 41

Percentage of positive cells for Gata4 and FoxA2 at day 20 after transfection of ADSCs with different expression vectors. After transfection cells were cultured in IMDM/F12 supplemented with different type of growth factors and small molecules (as described in Table 4). The percentage of immunopositive cells was determined by the Cellomics ™ ArrayScan HCS Reader.

| | Day 20 | | |
|---|---|---|---|
| | cell count | Gata4% | FoxA2% |
| GFP | 4825 | 0.21 | 0.23 |
| untransfected | 18646 | 0.01 | 0.03 |
| MBD2/Oct4/Sox17 | 12563 | 0.17 | 0.35 |
| MBD2/Oct4/Pdx1 | 13481 | 2.61 | 0.2 |
| MBD2/FoxA2/Pdx1 | 13418 | 0.17 | 0.16 |
| Sox17/Pdx1/Ngn3 | 15306 | 11.15 | 16.9 |
| MBD2/Ngn3/Sox17 | 19867 | 1.32 | 0.31 |
| MBD2/Ngn3/FoxA2 | 14984 | 0.33 | 0.42 |
| MBD2/Ngn3/Pdx1 | 18613 | 0.31 | 10.29 |
| Oct4/Sox17/Pdx1/Ngn3 | 19515 | 21.07 | 30.02 |
| Oct4/Pdx1/Ngn3 | 6103 | 0.28 | 0.49 |
| FoxA2/Pdx1/Sox17 | 10001 | 0.65 | 8.82 |

Transfection with Pdx1, Ngn3, Sox17 (and Oct4) Increased significantly selected pancreas-related genes (Pdx1, Ngn3, NKX2.2, Gata4, FoxA2) indicating a transition from endoderm to a pancreatic fate during this time period. To evaluate pancreatic hormone secretion, pancreatic-like cells were cultured for 50 days, during which time the medium was replaced with fresh medium every two days. We then assayed the supernatant for insulin in the conditioned medium by antigen-capture ELISA kit (Abnova, KA0921) at different time points (day 25 and day 55) and compared to the release of insulin in control cultures. According to the manufacturer's instructions, briefly, 96-well ELISA Immunoplates were coated with Anti-insulin (CatNb #) diluted 1/1000 in carbonate buffer (pH 9.7) and incubated at 4° C. overnight. The following day, all wells were washed with TBS-Tween 0.5% before incubation with Block/Sample buffer 1× at room temperature for one hour without shaking. After blocking, standards and samples were added to the plates and incubated and shaken (450±100 rpm) for 2 h at room temperature. Subsequently, after washing with TBS-Tween wash buffer, plates were incubated for 2 h with Anti-Human insulin pAb (1:500 dilution in Block & Sample 1× Buffer) at 4° C. After incubation, plates were washed five times with TBS-Tween 0.5% wash buffer and 100 µl of standard and sample was added in the plates precoated with anti-insulin and incubated for 1 hour at room temperature with shaking (450±100 rpm). Then, plates were washed five times with TBS-Tween 0.5% wash buffer and 100 µl of TMB One Solution was added to each well. Following 10 minutes incubation at room temperature with shaking (450±100 rpm) for the insulin plate, a blue color formed in the wells. After stopping the reaction by adding 100 µl of 1N hydrochloric acid, the absorbance was read at 450 nm on a microplate reader (Synergy 4) within 30 minutes of stopping the reactions. Concentration of released insulin in the supernatants was determined according to the standard curves. ELISA results revealed that insulin was released from cells transfected with Oct4/Sox17/Pdx1/Ngn3, and to a lesser extent in the other groups as summarized in Table 42.

TABLE 42

Quantification of insulin release by pancreatic progenitor/β-like cells that had been cultured for 25 and 55 days after transfecting ADSCs. Insulin release into the medium, at days 25 and 55, was measured by antigen-capture ELISA (Abnova).

| Insulin release | Concentration of insulin (µIU/ml) at day 25 | Concentration of insulin (µIU/ml) at day 50 |
|---|---|---|
| MBD2/Oct4/Sox17 | 0.05 | 0.07 |
| MBD2/Oct4//Pdx1 | 1.02 | 1.87 |
| MBD2/FoxA2/PDX1 | 1.13 | 1.11 |
| Sox17/PDX1/Ngn3 | 2.3 | 4.32 |
| MBD2/Npt3/Sox17 | 0.07 | 1.03 |
| MBD2/FoxA2/NGN3 | 0.09 | 1.30 |
| MBD2/PDX1/Ngn3 | 1.23 | 1.03 |
| Oct4/Sox17/Pdx1/Ngn3 | 4.32 | 7.85 |
| Oct4/Pdx1/Ngn3 | 2.45 | 3.21 |
| FoxA2/Pdx1/Sox17 | 1.02 | 1.23 |
| ADSC untransfected | 0.01 | 0.03 |

In addition to increase of gene expression, the transfecting cells were able to release insulin even in low concentrations. Generating reprogrammed ß-like cell lines that can locally deliver insulin could be used as a method to treat and allow functional recovery from diabetes.

Example XXIII: Transfection of ADSCs by Various Combinations of Genes and Treatment with Different Small Molecules for Reprogramming to Cardiac Progenitor-Like Cells ADSCs were cultured in StemPro™ MSC serum-free medium (Invitrogen) as previously described, and then transfected with different combinations of cDNA clones as described in Table 43 using the Nucleofector® 96-well Shuttle® Device (Lonza) as described previously. After transfection, the cells were plated on Matrigel-coated plates and incubated at 37° C., 5% $CO_2$, 5% $O_2$. Medium was changed every other day according to Table 44. Cells were analyzed at Day 20 by Quantitative Real-time PCR and by Immunohistochemistry.

TABLE 43

Various combinations of plasmids with potential to transfect the cells towards Cardiac Progenitor-like cells lineage.

| | Day −3 to Day 0 | Plasmids transfected at Day 0[1] |
|---|---|---|
| 1 | Pre-treated with VPA & 5-Aza | T, FoxD3, Sox17, Mesp1 |
| 2 | | Foxd3, Sox17, Mesp1, Nkx2.5 |
| 3 | | Foxd3, Tbx5, Baf, Nkx2.5 |
| 4 | | Foxd3, T, Mesp1, Gata6 |
| 5 | | Sox17, Tbx5, Baf, Nkx2.5 |
| 6 | | Foxd3, T, Mesp1, Gata4 |
| 7 | | T, Tbx5, Baf, Nkx 2.5 |
| 8 | | Foxd3, T, Mesp1, Tbx5 |
| 9 | | Mesp1, Tbx5, Baf, Nkx2.5 |
| 10 | | Foxd3, T, Mesp1, Tbx5 |
| 11 | | Foxd3, Sox17, Mesp1, Gata6 |
| 12 | | Foxd3, Sox17, Mesp1, Gata4 |
| 13 | | FoxD3, Sox17, Mesp1, Tbx5 GFP |

TABLE 44 media composition from day −3 to day 20.
Media Composition[1]

| Day −3 to 0 | Day 1 | Day 2 to Day 3 | Day 4 to Day 6 | Day 7 to Day 20 |
|---|---|---|---|---|
| StemPRo medium + VPA + 5-Aza | IMDM/F12 (50%) + NEAA (1X) + ITS + HAS (5 mg/ml) + VPA + Activin A (30 ng/ml) + CHIR99021 (2 nM) | IMDM/F12 + NEAA + ITS + HSA + FGF8 (10 ng/ml) + 5Aza + VPA + CHIR99021 (2 nM) + Wnt 11 (50 ng/ml) + BMP4 (50 ng/ml) | IMDM/F12 + NEAA + ITS + HSA + FGF8 (10 ng/ml) + FGF (50 ng/ml) + 5Aza + CHIR99021 (2 nM) + Wnt 11 (50 ng/ml) + BMP4 (50 ng/ml) | IMDM/F12 + NEAA + ITS + HSA + FGF (50 ng/ml) + BMP4 (50 ng/ml) |

[1]Supplements added to media at the following concentrations: Activin A (Peprotech, 30 ng/ml), HSA (Baxter, 0.5%), NEAA (Gibco, 1X), ITS (Gibco, 1X), FGF8 (Peprotech, 10 ng/ml), bFGF (Peprotech, 50 ng/ml), CHIR99021 (Stemgent, 2 uM), VPA (Stemgent, 1 mM), 5-Aza (Sigma, 0.5 uM), BMP4 (Peprotech, 50 ng/ml)

Cells were collected on Day 20 by detaching with TrypLE, followed by centrifugation at 80×g for 5 minutes. Supernatant was aspirated and the cell pellet was frozen at −86° C. until ready for RNA Isolation. RNA isolation, cDNA preparation and quantitative real-time PCR was performed as previously described.

Gene expression analysis on day 20 following transfection revealed an increased of several Mesoderm markers. Interestingly, three markers for cardiac progenitors cells (Nkx2.5, MyoCD, Tbx5) and three markers of early mesoderm lineage (Gata4, Mesp1, and Meox1) were highly increased after transfecting cells with brachyury (T)/Tbx5/Nkx2.2/Mesp1. Similarly, expression of Mesp1, Tbx5, Nkx2.5, MyoCd, and Meox1 was increased after transfecting the cells with Foxd3/Sox17/Mesp1/Tbx5; while expression of Mesp1, Gata4, Nkx2.5, MyoCd, and Meox1 was increased after transfecting with Foxd3/Sox17/Mesp1/Nkx2.5 and Foxd3/T/Mesp1/Gata4. As shown in Table 45, the Relative Expression of mesoderm and cardiac progenitor cells markers are especially up-regulated in the combination of Mesp1/Tbx5/Nkx2.5/T, Foxd3/Sox17/Mesp1/Nkx2.5 or/Tbx5, and Foxd3/T/Mesp1/Gata4. In general, transfection of ADSCs with a combination Mesp1, FoxD3, Tbx5, Brachyury, Nkx2.5, Sox17 and/or Gata4 increased the expression of mesoderm and cardiac progenitors markers.

In addition, samples were collected at day 20 to evaluate the nature of reprogrammed cells by analyzing the expression of mesoderm markers using Immunohistochemistry analysis for Brachyury and Nkx2.5 according to the methods previously described. Brachyury was significantly expressed in the Mesp1/Tbx5/Nkx2.5/T, Foxd3/Sox17/Mesp1/Nkx2.5 or/Tbx5, and Foxd3/T/Mesp1/Gata4 groups, while all groups expressed Nkx2.5. These cells could represent and invaluable source of cells to investigate furthermore human cardiac cells and also represent a potential source of cells for deriving patient-specific multipotent stem cells for modeling, regenerating, or treating human cardiovascular diseases.

TABLE 45

Relative Expression Gata4, Mesp1, Tbx5, Nkx 2.5, MyoCD, and Meox1, after transfecting ADCs once with various gene combinations with potential to reprogram ADSCs cells into Cardiac Progenitor-like cells.
Relative Expression Gata4, Mesp1, Tbx5, Nkx 2.5, MyoCD, and Meox1, after transfecting ADCs once with various gene combinations with potential to reprogram ADSCs cells into Cardiac Progenitor-like cells.

| Day 20 | Gata4 Rel. Exp. | Std. Dev. | MESP1 Rel. Exp. | Std. Dev. | TBX5 Rel. Exp. | Std. Dev. | NKX2.5 Rel. Exp. | Std. Dev. | MYOCD Rel. Exp. | Std. Dev. | MEOX1 Rel. Exp. | Std. Dev. |
|---|---|---|---|---|---|---|---|---|---|---|---|---|
| GFP-transfected ADCs | 1.01 | 0.16 | 1.01 | 0.19 | 1.00 | 0.05 | 1.02 | 0.27 | 1.00 | 0.07 | 1.02 | 0.27 |
| Foxd3/Sox17/T/Mesp1 | 0.02 | 0.01 | 6.70 | 1.18 | 1.52 | 0.12 | 0.94 | 0.07 | 1.98 | 0.13 | 1.37 | 0.10 |
| Foxd3/Tbx5/Baf60c/Nkx2.5 | 0.08 | 0.03 | 1.86 | 0.20 | 1.59 | 0.08 | 24.94 | 2.97 | 2.11 | 0.11 | 1.17 | 0.15 |
| Sox17/Tbx5/Baf60c/Nkx2.5 | 0.62 | 0.09 | 3.89 | 0.10 | 1.45 | 0.00 | 41.72 | 2.35 | 0.90 | 0.02 | 1.19 | 0.02 |
| T/Tbx5/Baf60c/Nkx2.5 | 0.93 | 0.12 | 7.59 | 0.61 | 1.76 | 0.12 | 27.54 | 2.36 | 0.94 | 0.05 | 1.23 | 0.19 |
| Mesp1/Tbx5/Baf60c/Nkx2.5 | 1.12 | 0.13 | 31.55 | 0.91 | 4.26 | 0.07 | 154.76 | 3.50 | 1.54 | 0.06 | 5.96 | 1.60 |
| Foxd3/Sox17/Mesp1/Gata6 | 0.71 | 0.02 | 19.59 | 0.76 | 1.77 | 0.15 | 31.38 | 1.23 | 1.44 | 0.09 | 3.30 | 0.68 |
| Foxd3/Sox17/Mesp1/Gata4 | 0.02 | 0.00 | 2.66 | 0.44 | 1.45 | 0.24 | 0.81 | 0.24 | 0.75 | 0.03 | 0.65 | 0.17 |
| Foxd3/Sox17/Mesp1/Tbx5 | 1.75 | 3.18 | 138.28 | 2.20 | 15.61 | 0.87 | 45.20 | 14.88 | 11.06 | 1.02 | 4.36 | 3.45 |
| Foxd3/Sox17/Mesp1/Nkx2.5 | 17.76 | 4.34 | 22.03 | 0.08 | 3.03 | 0.01 | 95.73 | 11.68 | 10.25 | 2.32 | 10.54 | 2.39 |

TABLE 45-continued

Relative Expression Gata4, Mesp1, Tbx5, Nkx 2.5, MyoCD, and Meox1, after transfecting ADCs once with various gene combinations with potential to reprogram ADSCs cells into Cardiac Progenitor-like cells.
Relative Expression Gata4, Mesp1, Tbx5, Nkx 2.5, MyoCD, and Meox1, after transfecting ADCs once with various gene combinations with potential to reprogram ADSCs cells into Cardiac Progenitor-like cells.

| Day 20 | Gata4 | | MESP1 | | TBX5 | | NKX2.5 | | MYOCD | | MEOX1 | |
|---|---|---|---|---|---|---|---|---|---|---|---|---|
| | Rel. Exp. | Std. Dev. | Rel. Exp. | Std. Dev. | Rel. Exp. | Std. Dev. | Rel. Exp. | Std. Dev. | Rel. Exp. | Std. Dev. | Rel. Exp. | Std. Dev. |
| Foxd3/T/Mesp1/Gata6 | 27.10 | 6.47 | 3.59 | 0.42 | 2.58 | 0.29 | 5.11 | 0.85 | 21.03 | 1.02 | 12.99 | 1.31 |
| Foxd3/T/Mesp1/Gata4 | 15.87 | 6.13 | 50.20 | 6.41 | 2.37 | 0.18 | 55.43 | 6.95 | 19.86 | 2.10 | 4.32 | 0.15 |
| Foxd3/T/Mesp1/Tbx5 | 0.83 | 0.02 | 8.20 | 0.48 | 2.40 | 0.37 | 29.25 | 1.28 | 0.76 | 0.08 | 1.40 | 0.46 |
| Foxd3/T/Mesp1/Nkx2.5 | 19.79 | 2.03 | 111.35 | 15.32 | 2.56 | 0.35 | 32.52 | 12.53 | 0.29 | 0.03 | 24.70 | 3.12 |
| T/Tbx5/Nkx2.5/Mesp1 | 18.46 | 1.06 | 103.09 | 22.28 | 102.53 | 15.02 | 96.32 | 16.60 | 15.32 | 5.01 | 15.73 | 2.83 |

Example XXIV: Reprogramming Human ADSCs to Pluripotent-Like Stem Cells (PLSC)

Based on previous results in Example XIX, the highest reprogramming efficiency was observed using pEF-Rex1-EF-Oct4-2A-Klf4-2A-RFP (NF10) and pCMV-Sall4-2A-Oct4-2A-Klf4-2A-Nanog (S71). ADSCs (Invitrogen Corporation) were cultured in cell culture flasks with complete StemPro-43 medium (Invitrogen) at 37° C., 5% $CO_2$ and the medium was changed 3 times per week. After 3 days in culture cells (passage 5) were trypsinized and counted to be transfected. Cells were transiently transfected with one plasmid: pCMV-Sall4-2A-Oct4-2A-Klf4-2A-Nanog or Rex1-EF-Oct4-2A-Klf4-2A-RFP (2 µg) using nucleofector as described in Example II. Following the transfection cells were cultured in 6-well plates in suspension with 50:50 ratio of adipocyte complete medium (StemPro-43) and embryonic stem cell medium (mTesR1). After two days in culture, cells were re-transfected with the same plasmids listed above and cells were plated in 96 well-plates coated with Matrigel (BD Biosciences) in the presence of mTesR complete medium supplemented with thiazovivin (0.5 µM), an ALK-5 inhibitor (SB 341542, Stemgent, 2 µM), and inhibitor of MEK (PD0325901, Stemgent, 0.5 µM). Medium was changed every day and cells were cultured for 22 days at 37° C., 5% $CO_2$, 5% $O_2$. Alkaline Phosphatase Detection Kit (AP, Millipore) and immunohistochemistry were performed to analyze the expression of pluripotency markers. ALP staining was performed using AP detection kit (Millipore) according to manufacturer's instructions. Colonies emerged around Day 15 and maintained in culture up to the end of the study period (up to 2 months) with a stable morphology. Live staining showed that these colonies express typical pluripotency markers, including SSEA-4 and TRA1-81, TRA1-60, Oct4, Nanog, Sox2, and E-cadherin. Further analysis of these colonies showed that the colonies present as well other ESC markers such as alkaline phosphatase (ALP, not shown). Supplementing the small molecules PD0325901 and SB431542 with the KSOR medium treated cultures, a 6 fold improvement in efficiency over the conventional method was obtained following the transfection of ADSCs with pCMV-pEF-Rex1-EF-Oct4-2A-Klf4-2A-RFP. This pattern did not change up to the 2 month culture period and same positive colonies were observed after transfecting ADSCs with Sall4-2A-Oct4-2A-Klf4-Nanog (not shown). The observation over time showed that the phenotype of these colonies moves from an early SSEA+ phenotype to a late Oct4+/Sox2+/Nanog+ phenotype, which is closer to the final reprogrammed state.

Following the reprogramming of ADSCs cells to Pluripotent-like cells using the two vectors pEF-Rex1-EF-Oct4-2A-Klf4-2A-RFP or pCMV-Sall4-2A-Oct4-2A-Klf4-2A-Nanog, a study was performed to examine the differentiation capacity of these cells. Beginning on Day 30, reprogrammed cells were cultured in conditions in order to stimulate the differentiation to embryonic bodies (EBs). These differentiation conditions consisted of placing the cells on uncoated petri-dish in EB Differentiation medium consisting of KSOR medium with FBS 5% without FGF for 45 days. To further differentiate the embryonic bodies, Day 30 EBs were cultured in three different media in order to drive cell differentiation to either ectoderm, mesoderm or endoderm lineages in CDM medium consisting of DMEM/F12 supplemented with 2 mM Glutamine, 0.11 mM 2-mercaptoethanol, 1 mM nonessential amino acids, and 0.5 mg/ml HAS (Yao S et al., PNAS 2006). This CDM medium was further supplemented with different concentrations of cytokines to induce the differentiation towards the three lineages. Ectoderm media consisted of N2/B27-CDM in the presence of Noggin (100 ng/ml) and after 10 days NGF (20 ng/ml) was added to the medium and the cells were grown on laminin-coated plates. Endoderm media consisted of N2/B27 CDM with the presence of Activin A (100 ng/ml) and the cells were grown on Gelatin-coated plates. Mesoderm media consisted of N2/B28-CDM in the presence of Activin A (50 ng/ml) and BMP-4 (50 ng/ml) and the cells were grown on Gelatin-coated plates. Cells that had originally been reprogrammed with pCMV-Sall4-2A-Oct4-2A-Klf4-2A-Nanog differentiated better than cells originally reprogrammed with pEF-Rex1-EF-Oct4-2A-Klf4-2A-RFP which detached from the coated plates. Visual observation of the differentiation of the cells into the three lineages was performed by RT-PCR and Cellomics using the Ectoderm markers (Nestin, GFAP, Beta-tubulin, Sox2), Endoderm markers (GATA4, Brachyury) and Mesoderm markers (GATA4, Brachyury, and Nkx2.5). RT-PCR analysis revealed the Identification of endoderm, mesoderm and ectoderm markers for all 3 embryonic germ layers (Table 46).

TABLE 46

RT-PCR analysis of three embryonic germ layers following the differentiation of PLSCs.

A - Ectoderm

| | CDH1 (E-cadherin) | | ASCL1 (MASH1) | | TP63 | | NOTCH1 | |
|---|---|---|---|---|---|---|---|---|
| | Rel. Exp. | Std. Dev. | Rel. Exp. | Std. Dev. | Rel. Exp. | Std. Dev. | Rel. Exp. | Std. Dev. |
| S71-transf. ADSC | 59180.71 | 2036.56 | 70.28 | 12.35 | 123114.61 | 17452.81 | 5.47 | 0.19 |
| NF10-transf. ADSC | 77944.51 | 1747.33 | 48.20 | 3.27 | 166929.89 | 6007.52 | 6.47 | 0.12 |
| Mel-2 Undifferentiated, P17 | 84021.24 | 178.93 | 9.80 | 4.30 | 10.72 | 2.96 | 5.90 | 0.48 |
| ADSC Untreated Ctrl | 1.20 | 0.93 | 1.00 | 0.00 | 1.00 | 0.00 | 1.00 | 0.03 |

B - Endoderm

| | SOX17 | | CDX2 | |
|---|---|---|---|---|
| | Rel. Exp. | Std. Dev. | Rel. Exp. | Std. Dev. |
| S71-transf. ADSC | 9.39 | 2.21 | 37.77 | 5.11 |
| NF10-transf. ADSC | 2.33 | 0.94 | 21.05 | 18.59 |
| Mel-2 Undifferentiated, P17 | 0.77 | 0.00 | 4.34 | 5.05 |
| ADSC Untreated Ctrl | 1.00 | 0.00 | 1.00 | 0.00 |

C - Mesoderm

| | FOXA2 | | GSC | | CXCR4 | |
|---|---|---|---|---|---|---|
| | Rel. Exp. | Std. Dev. | Rel. Exp. | Std. Dev. | Rel. Exp. | Std. Dev. |
| S71-transf. ADSC | 1193.70 | 51.50 | 0.85 | 0.11 | 512.33 | 45.62 |
| NF10-transf. ADSC | 1662.76 | 160.28 | 0.57 | 0.01 | 352.65 | 39.26 |
| Mel-2 Undifferentiated, P17 | 191.53 | 18.61 | 0.01 | 0.01 | 105.05 | 10.62 |
| ADSC Untreated Ctrl | 1.00 | 0.00 | 1.00 | 0.06 | 1.19 | 0.91 |

The Expression of TP63 (Ectoderm/Surface Ectoderm) was up-regulated in both the Day 71 S71-transfected sample (123,000-fold) and the Day 75 NF10-transfected sample (167,000-fold) as compared to the ADSC untreated control. The expression of NOTCH1, a marker for the neuroectoderm, was slightly up-regulated in the Day 71 S71-transfected sample (5-fold) and the Day 75 NF10-transfected sample (6-fold) as compared to the ADSC untreated control. Expression of CDH1/E-cadherin, surface ectoderm marker, was up-regulated in both the Day 71 S71-transfected sample (59,000-fold) and the Day 75 NF10-transfected sample (78,000-fold) as compared to the ADSC untreated control. Furthermore, the expression of ASCL1/MASH1, a neural crest marker, was up-regulated in both the Day 71 S71-transfected sample (70-fold) and the Day 75 NF10-transfected sample (48-fold) as compared to the ADSC untreated control.

The expression of definitive endoderm markers were analyzed, such as SOX17, CDX2, and NKX2.1. The expression of SOX17 was up-regulated in the Day 71 S71-transfected sample (9-fold) as compared to the ADSC untreated control. CDX2 gene expression is up-regulated in both the Day 71 S71-transfected sample (38-fold) and the Day 75 NF10-transfected sample (27-fold) as compared to the ADSC untreated control. However, NKX2-1 (Endoderm-Primitive Gut Derivative) was not expressed in any of the 4 test samples at the time points tested.

Markers of Mesoderm were analyzed as well: the expression of T (Mesoderm) was up-regulated in the Day 71 S71-transfected sample (16-fold) as compared to the ADSC untreated control. However the expression of MEOX1, OSR1 (intermediate mesoderm), and FOXF1 (lateral mesoderm) was decreased in both the S71-transfected and the NF10-transfected samples as compared to the ADSC Untreated Ctrl. The expression of GATA4 is up-regulated in both the Day 71 S71-transfected sample (150-fold) and the Day 75 NF10-transfected sample (110-fold) as compared to the ADSC untreated control.

The expression of FOXA2 (Mesendoderm, Mesoderm, Endoderm) was up-regulated in both the Day 71 S71-transfected sample (1,100-fold) and the Day 75 NF10-transfected sample (1,600-fold) as compared to the ADSC untreated control. No significant change in GSC (mesoendoderm, Endoderm) expression for both the S71-transfected and the NF10-transfected samples as compared to the ADSC Untreated Ctrl. The expression of CXCR4, a marker for Mesoderm/Endoderm, was up-regulated in both the Day 71 S71-transfected sample (500-fold) and the Day 75 NF10-transfected sample (350-fold) as compared to the ADSC untreated control.

Using immunohistochemistry, the potential of PLSCs to express and differentiate into the three embryonic layers markers was analyzed. Consistent with their hES-like morphology, PLSCs were able to differentiation towards the three lineages:

Ectodermal differentiation: Nestin is strongly and widely expressed throughout the experiment. The neural markers GFAP and ßIII-tubulin are also expressed, while Sox2 as a neural precursor marker was not detectable at the time points tested, indicating that cells had already differentiated into the neural pathway. At day 12 and 18, many cells co-expressed GFAP and ßIII-tubulin. At day 28, however, GFAP expressing cells have almost completely disappeared, while ßIII-tubulin positive cells with well formed neurites become detectable. The medium supported neural differentiation, but less astrocyte differentiation, since, especially at day 12 and 18, there are high amounts of GFAP-positive collapsed cells detectable, indicating massive cell death of this type of cells. The omnipresence of the neural markers suggest that differentiation occurs along the neural pathway in this media; although different differentiation lineages could be achieved with different media compositions and growth substrates/ growth conditions known in the art. By Day 12 of differentiation, the expression of the stem cell markers Oct4 and Nanog are completely suppressed.

Endodermal differentiation: Large fields of cells that are positive for FoxA2 are detectable indicating endodermal differentiation.

Mesodermal differentiation: Cells treated for mesodermal differentiation cease to express Oct4 and nanog (not shown), indicating that they indeed started to differentiate. The strong and ubiquitous expression of GATA4 and the later appearance of nuclear Nkx2.5 stain indicate that many cells might develop a cardiac profile in the conditions tested. There are some cell clusters that express brachyury staining together with GATA4.

As for the Ectoderm and Endoderm differentiation, different media compositions and growth substrates/growth conditions known in the art would promote the acquisition of other differentiation lineages.

Example XXV: Cytotoxic Effects of Human PLSCs

Human Hepatocellular Carcinoma cell line (HepG2, CRL-10741, ATCC) were seeded in a 24 well plate ($1\times10^4$ cells/cm$^2$) in DMEM with 10% Fetal bovine serum (FBS). PLSCs were harvested using dispase and seeded ($1\times10^4$ cells/cm$^2$) in transwells (Corning, 0.4 µm) above the HepG2 containing wells. The HepG2 cells were analyzed for cytotoxicity after 24 hours by high-content analysis staining by Propodium Iodide, Yopro1, and Ethidium Heterodimer (cell-impermeable DNA stains that stain only cells with a compromised plasma membrane as occurs in unhealthy cells) along with Calcein (a live stain, marking enzymatic activity in the cytoplasm), Mitotracker Red (marks active, healthy mitochondria) and Cleaved Caspase 3 (a marker for apoptotic or stressed cells). HepG2 cells in the presence of PLSCs had significantly less Propodium Iodide, Yopro1 and Cleaved Caspase 3 staining indicating that the PLSCs had a protective and/or therapeutic/regenerative effect on these cells (Table 47).

Example XXVI: Teratoma Formation Assay in Immunodeficient NOD-SCID Mice

Fifty million human NSLCs derived from fibroblast cells (HFF) and fifty millions NSLCs derived from blood cells (CD34+) (according to Examples IV and IX), as well as twenty-five million Human embryonic stem cells (Mel2) were prepared as units of five million cells each embedded with 30% Matrigel (Invitrogen) in 200 µl phosphate buffered saline which were then injected subcutaneously into the back of individual NOD/SCID mice using a 21-G needle within 20 minutes of preparation. Each cell line had been in culture for approximately 1 month prior to the study. Thus 10 mice received an injection of 5 million NSLCs derived from HFF, 10 mice received an injection of 5 million NSLCs derived from CD34+ cells, and 5 mice received an injection of 5 million Mel2 cells. All standard and appropriate animal approval and ethical committee approvals were obtained prior to the commencement of the study.

Although the study was for 3 months, within 1 month of injection one of the mice injected with the Mel2 cells had to be sacrificed due to the size of the teratoma that had formed according to the animal approval protocol. Less than 3 weeks later, the rest of the Mel2 injected mice had to also be sacrificed due to the size of the teratoma that had formed. None of the 10 mice injected with NSLCs derived from fibroblast cells or the 10 mice injected with NSLCs derived from CD34+ blood cells formed any tumors or teratomas, indicating that these NSLCs are safe multipotent stem cells.

Example XXVII: Differentiation of NSLC Derived from HFF, CD34+ Cells, and Keratinocytes to Different Neuronal Lineages To investigate the differentiation potential of NSLCs to different types of neurons, NSLC Neurospheres were dissociated and plated onto laminin/poly-D-Lysine (10 µg/ml; Sigma) coated plates in NeuroCult differentiation medium (NeuroCult Differentiation basal, StemCell Technologies) supplemented with NeuroCult® SM1 Neuronal Supplement and BDNF (20 ng/ml, Peprotech), bFGF (40 ng/ml, Peprotech), FGF 8 (20 ng/ml, Peprotech) and SHH (20 ng/ml, Peprotech) for 30 days. NeuroCult® SM1 (StemCell Technologies) is a standardized serum-free supplement containing antioxidants and retinoic acid; its formulation was developed based on the published supplement formulation identified as B27 but has been optimized to give reproducibly high numbers of functional neurons with minimal glial cell contamination (<1% GFAP+). After one month in culture, the cells were stained with the neuronal marker tyrosine hydroxylase, acetycholine, GABA, and Dopamine.

TABLE 47

The percentage of Yopro1, Propidium, ethidium Heterodimer, Calcein AM, Mitotracker Red, and Cleaved Caspase-3 positive cells for untreated and PLSCs treated hepatocytes.

| | | % positive cells | | | | | Average intensity |
|---|---|---|---|---|---|---|---|
| | Number of cells | Yopro1 | Propidium Iodide | Ethidium Heterodimer | CalceinAM | Cleaved Caspase3 | Mitotracker Red |
| HepG2 untreated | 14539 ± 1359 | 5.15 ± 0.47 | 4.57 ± 0.21 | 5.66 ± 0.02 | 69.41 ± 1.44 | 0.95 ± 0.05 | 26.88 ± 3.52 |
| HepG2, PSLC treated | 12498 ± 1454 | 3.41 ± 0.37 | 3.85 ± 0.36 | 5.81 ± 0.33 | 71.67 ± 1.55 | 0.63 ± 0.03 | 27.99 ± 3.74 |

All cell lines stained positive for each of these markers. Immunohistochemistry analysis showed that differentiation medium supplemented with Neurocult SM1 and neurotrophic factors promoted the differentiation of NSLCs derived from HFF, CD34+ cells, and Keratinocytes to dopaminergic, adrenergic, and Gabanergic neurons.

This study showed that NSLCs derived from fibroblast, keratinocyte, or blood cells are capable to differentiate towards different types of neurons in the appropriate differentiation conditions. The specific neurons could be used to treat diseases where such neurons are affected or have been lost, for example, dopaminergic neurons in Parkinson's disease. Other types of multipotent stem cells and progenitor cells prepared according to the methods in the previous examples would be expected to reprogram or differentiate

Example XXVIII: Comparison of Expression of Specific Genes in Human HFFs, NSLCs Created from the HFFs, and Human Primary Neuroprogenitor Cells The expression of selected genes and proteins in NSLCs created from HFFs according to Example IV were determined. Total RNA was extracted from cells, using Trizol following manufacturer's recommendation. Briefly, cells were examined for the expression of different genes associated with pluripotency: SOX2 (460 bp), OCT4a (172 bp), OCT4b (169 bp) and NANOG (276 bp); early neural markers: SOX2 (460 bp), NES (327 bp), CD133 (200 bp), PAX6 (431 bp) and ASCL (220 bp); Notch signaling: NOTCH1 (126 bp), NOTCH2 (475 bp), HES1 (314 bp) and HES5 (265 bp); neurotrophic factors: GDNF (389 bp) and BDNF (743 bp) and astrocyte marker GFAP (650 bp) and markers of neurons: NFL (284 bp), NFM (333 bp), NFH (316 bp), SYN (289 bp), NSE (292 bp) and MAP2 (321 bp). Positive controls used were NT2 cells (human NT2/DI teratomacarcinoma cell line (ATCC), NT2-derived neurons (NT2-N) and astrocytes (NT2-A) and SH-SY5Y cells were appropriate. No template control was used as negative control for every gene examined.

NSLCs had the same expression profile as human primary neuroprogenitor cells (NP; Lonza), namely in terms of expression of Sox2, Oct4b, Notch1, Notch2, Hes1, Hes5, Nestin, CD133, Pax6, Ascl1 (Mash1), NFL, NFM, NSE and Map2, but additionally the of the neurotrophic factors GDNF and BDNF. The HFF cells that the NSLCs were created from also expressed Oct4b (Oct4b is a splicing variant of Oct4a (a stem cell marker) which expression is not limited to stem cells), Nestin, some of the notch signaling genes and neuronal markers, making it significantly easier to reprogram than adult dermal fibroblasts that do not express this genes (thus, for example, Nestin is important to add to the reprogramming cocktail when reprogramming adult fibroblasts to NSLCs).

Next immunohistochemistry was used to confirm that the encoded protein of some of the above expressed genes was present in the cells. Cells were fixed with 65% Ethanol and 0.15M NaCl for 20 minutes and stained for the following proteins: SOX2, NES, GFAP, MAP2, NCAM and RBPJ (green). Phase and Hoechst (blue) counter stain was also preformed. NT2 and NP cells were used as comparison and positive controls. NSLCs expressed intense staining for Sox2, Nestin, GFAP, Map2, and RBPJ with only a small amount of NCAM detected. NP cells had an identical staining pattern to the NSLCs except slightly less intense staining especially for Sox2 and Nestin. The NT2 cells only expressed Sox2, Nestin and RBPJ at appreciable levels. The HFFs from which the NSLCs were created from only expressed Nestin and RBPJ at appreciable levels.

Example XXIX: Potential of NSLCs for CNS Therapeutic Applications

NSLCs prepared from HFFs according to Example IV were tested for their ability to form functional cell-cell communication through gap junctions, which is an important characteristic for therapeutic potential when implanted into the CNS. Dye coupling experiments showed functional cell-cell communication in NSLC cells through gap junctions. A single NSCL cell was pre-loaded with two dyes [Dil (red) and calcein AM (green)] and plated on an unlabeled layer of NSCL cells. Calcein readily transferred from the donor cells to a large population of receiving cells after 3 hours in vitro, confirming gap Junctional intercellular communication among NSCL cells.

Next NSLCs were tested for the expression of synaptotagmin (a synaptic vesicle protein) and MAP2 (a neural differentiation associated marker) since NSLCs have some unique characteristics over native neural stem/progenitor cells including expression of some growth factors as well as a more significant expression of some neural differentiation markers while maintaining the ability to remain in a stem cell like state. NSLCs were found to readily express synaptotagmin and Map2.

Next NSLCs were tested for their tolerance to glutamate and NMDA to determine their potential robustness in areas of significant ischemia, trauma, and neurodegeneration in the CNS. NSLCs maintained a healthy neuronal state in the presence of glutamate (200 mM), a characteristic not observed in the presence of NMDA (25 mM), indicating an ability to form synapses upon neuronal differentiation.

Next the NSLCs were tested for their ability to attach and survive on 3D scaffolds; in this case PGA scaffolds. NSLCs were found to readily attach to the PGA scaffolds designed for implantation into the brain. Carboxyfluourodiacetate (CFDA) confirms optimal cell survival (>93%) 24 hours after cells were plated on the scaffold. NSLCs showed robust attachment and survival to the surface for at least one week in vitro. Furthermore, Neurites grew along the length of each PGA fiber, following the pattern of the scaffold, indicating that NSLCs can be grown on 3D scaffold and structures useful for implantation into humans or animals, or for in vitro modeling.

Example XXX: Neural Stem-Like Chromatin State of Neural Stem-Like Cells

Human keratinocytes (Invitrogen, Cat. #12332-011), CD34$^+$ hematopoietic cells (StemCell Technologies, Cat. #MPB015F), and neonatal foreskin fibroblasts (HFF, American Type Culture Collection, Cat. #CRL-2097)) were transfected with pCMV-MSI1-2A-Ngn2 and pCMV6-XL5-MBD2 and grown in neural stem cell medium supplemented with EGF and FGF2 (NeuroCult Proliferation Kit Cat. #5751, StemCell Technologies) on CELLStart™ (Invitrogen, Cat. #A10142-01) coated plates at 37° C., 10% CO$_2$, 5% O$_2$ and supplemented with VPA and Noggin for the first 6 days. Neural stem-like cells (NSLC) expressing Nestin, Sox2 and GFAP were obtained within 1-2 weeks from each cell line and allowed to proliferate for at least 7 passages.

Since one of the most widely used markers for neural stem cells is Nestin expression and all the NSLC expressed Nestin, Bisulfite genomic sequencing was performed on the second intron region of Nestin to determine its methylation status in each of the 3 NSLC lines to determine if this gene becomes unmethylated in NSLCs thus allowing stable endogenous expression of this neural stem cell gene. The original keratinocyte, CD34$^+$ hematopoietic cells, and HFF cell were used as comparison controls, and normal human fetal neuroprogenitor cells (NPC) as a positive control. Nestin is methylated in most other cells, and thus not significantly expressed, since methylation in the 5-position of a cytosine in a cytosine-phosphate-guanosine (CpG) dinucleotide results in long-term gene silencing and thus no gene expression. To determine the Nestin gene methylation status of each of these cells, genomic DNA was isolated with the DNeasy kit (Qiagen, Toronto, Ontario) and bisulfite treatment was carried out using EZ DNA Methylation-Gold Kit (ZYMO Research, Irvine, California). The second intron region of the human Nestin gene was amplified by PCR (40 cycles of denaturation at 94° C. for 30 s, annealing at 55° C. for 30 s, extension at 72° C. for 30 s with a 1st denaturation at 94° C. for 5 min for Hot-Start TAQ activation, and a final extension at 72° C. for 10 min), then purified (PCR Purification Kit, Qiagen), subcloned using the TOPO TA PCR Cloning Kit (Invitrogen) and 5 randomly selected clones were sequenced (IRIC Genomics platform, Universite de Montreal). The promoter in the starting cells was hypermethylated as expected for these cells, but was demethylated in all NSLC similarly to NPC. Thus during the reprogramming process NSLC gain a neural stem-like chromatin state as shown by the DNA demethylation status of specific loci, indicating genomic stability of the reprogramming event, but also epigenetic resetting of the fibroblast, keratinocyte, and CD34+ cell genomes to a neural stem-like state.

Example XXXI: Normal Karyotype (Chromosomes) in Stem-Like Cells

A karyotype analysis was performed to confirm that normal chromosomes were maintained in neural stem-like cells (NSLC). NSLC derived from either CD34+ cells or HFF (from Example 1) were arrested with colchicine (10 μg/ml) for 30 min. Chromosome preparations were made by incubating the cell suspension in 0.075M KCl at 37° C. for 13 min, followed by a fixation step in a freshly prepared mixture of 3:1 methanol:acetic acid at −20° C. GTG banding was performed by incubating the glass slides in a 0.05% trypsing solution (Difco) at 37° C. for 15 sec, followed by rinsing the slides in phosphate-buffered saline and staining in a 5% Giemsa stain for 8 min. The slides were rinsed with water and air-dried. The slides were stained with DAPI, washed in distilled water, and dried at ambient temperature. The preparations were examined under imaging fluorescent microscope (Zeiss) and analysis of biologic chromosome structures was performed after GTG banding.

No karyotypic abnormalities were observed in NSLC derived from CD34+ and HFF. The light and dark bands are clearly detectable and all chromosomes could be identified.

Example XXXII: Stem-Like Cells do not Form Tumors or Teratomas

NSLC derived from either CD34+ cells or HFF (from Example 1) were injected subcutaneously into Fox-Chase® SCID Beige mice at a concentration of approximately 250 million NSLC per kilogram of body weight. This cell concentration would represent an equivalent injection of approximately 15 billion NSLCs into an average 60 kg adult human. During the 120-day follow-up, no tumors or teratomas were observed by gross necropsy nor by histopathological analysis in any of the NSLC-implanted animals. In comparison all animals that were injected with human embryonic stem cells (MEL-2 hES cells) had to be euthanized before the end of the study (Days 36-46) due to the formation of massive tumors/teratomas at the site of injection, hence confirming the sensitivity of this study in being able to detect any tumor/teratoma forming cells.

Example XXXIII: Creation of Stem-Like Cells Using RNA

Human neonatal foreskin fibroblasts (HFF, American Type Culture Collection, Cat. #CRL-2097)) were transfected with synthetic messenger RNAs (mRNAs) of MSi1, NGN2 and MBD2. The mRNAs were synthesized as standard RNAs using T7 mScript Standard mRNA Production System from CellScript (Cat #C-MSC100625). To promote efficient translation, the mRNAs were modified by enzymatic capping and A-tailing as described in the mScript Standard mRNA production system.

For the transfection method, 20,000 cells were seeded per well in a 96-well laminin-coated plate in neural stem cell medium supplemented with EGF and FGF2 (NeuroCult Proliferation Kit Cat. #5751, StemCell Technologies) at 37° C., 10% $CO_2$, 5% $O_2$ and supplemented with VPA and Noggin for the first 8 days. The cells were transfected on Day 2 with the MSI1, NGN2 and MBD2 mRNA using TransIT mRNA transfection reagent (Mirus, Cat #MIR 2250): the mRNA was diluted in 100 μl OptiMEM and incubated 2-5 min with 2 μl Boost and 2 μl transfection reagent for each μg of RNA. A total of 100 ng mRNAs was administered to each well. The transfections were repeated with MSi1, NGN2 on Days 4, 6 and 8.

Neural stem-like cells (NSLC) expressing Nestin and Sox2 were obtained within 1-2 weeks, along with ßIII-tubulin expressing cells (about half of all cells) with early neuronal-like phenotype after 14 days of differentiation.

It is thus expected that a similar methodology of transfecting/introducing the MSi1, NGN2 and MBD2 proteins into isolated starting cells can be used to create neural stem-like cells. It is also expected that the same methodology can be used to create other types of stem-like cells using the appropriate reprogramming agents.

Example XXXIV: Creation of Hematopoietic Stem-Like Cells

Human adipocyte-derived stem cells (ADSC, Invitrogen) and HFF (ATCC, Cat. #CRL-2097) were transfected every other day for a total of three times with combinations of pCMV6-AC-CDX4, pCMV-AC-Gata1, pCMV-AC-Gata2, pCMV-XL5-HoxB4, pCMV-XL5-T, and pCMV-AC-KLF1 (all from Origene) and grown in hematopoietic stem cell medium (complete StemPro-43 medium, Invitrogen) on Lamini-411 (Biolamina) coated plates at 37° C., 10% $CO_2$, 5% $O_2$ and supplemented with Stem Cell Factor (100 ng/ml, R&D Systems), IL-3 (50 ng/ml, R&D Systems), GM-CSF (25 ng/ml, R&D Systems), and human TPO (50 ng/ml, R&D Systems). After 2 weeks, the cells were transferred to a low-bind petri-dish (Corning) and grown in complete StemPro-43 medium supplemented with 3 U/ml erythropoietin, 50 ng/ml SCF, 20 ng/ml GM-SCF, 20 ng/ml IL-3, 20 ng/ml IL-6. Formed colonies were analyzed for the expression of CD34+ and Sca-1 indicating the presence of hematopoietic stem-like cells (HSLC).

Example XXXV: Creation of Cardiac Stem-Like Cells

Human Mensenchymal Stem Cells (MSCs, Lonza) were seeded on cellbind flasks (Corning) at $2.1 \times 10^4$ per $cm^2$ of tissue culture surface area and expanded in cell culture flasks with complete mesenchymal stem cell media (MSCGM, Lonza) containing mesenchymal basal medium and MSC growth supplements. The medium was changed twice per week. Cells were trypsinized using Tryple (Invitrogen) for 4 minutes at 37° C., pelleting the cells by centrifugation, washing the cells once with PBS, and plating the cells at a ratio of 1:2 onto tissue culture flasks until a suitable number of cells was reached.

Cells were then transfected using the Amaxa Nucleofector™ 96-well Shuttle Device (Lonza). The MSCs were harvested with Tryple (Invitrogen), resuspended in MSCGM Medium and centrifuged for 10 min at 200×g (1×10$^6$ cells/tube). The supernatant was discarded and gently resuspended in 80 μl of Basic Nucleofector Solution (Basic Nucleofector kit for primary Mammalian MSC, Lonza). Each 80 μl of cell suspension was combined with a different mix of plasmid DNA (pCMV-XL4-Tbx5, pCMV-XL5-Mesp1, pCMV-XL5-Brachyury or pCMV-XL4-Nkx2.5, pCMV-XL5-Mesp1, pCMV-XL5-Brachyury). The cell suspension was transferred into an Amaxa certified shuttle 96 well-plate and transfected with the appropriate program (V4SP-1096). The sample was transferred into a Laminin-211 (Biolamina) or Gelatin 0.1% coated culture plate, and the cells were incubated at 37° C., 5% CO$_2$. After 24 hours, the medium was changed to maintenance medium consisting of RPMI 1640, with L-glutamine and sodium pyruvate supplemented with the following components: bFGF (20 ng/ml), ITS (1×), Activin A (30 ng/ml), BMP4 (20 ng/ml), NRG (10 ng/ml), Valproic acid (VPA) (0.5 mM), and 5-azacytidine (5-Aza) (0.5 μM). After two days, cells were retransfected using lipofectamine with 2 μg of pCMV6-XL5-T, pCMV-XL4-TBX5, pCMV-XL-Mesp1 or pCMV-XL5-Mesp1, pCMV6-XL5-T, pCMV-XL4-NKX2.5 using lipofectamine reagent (Invitrogen) as per the manufacturer's protocol. The DNA-lipid complex was added to cells and incubated for 24 h at 37° C., 5% CO$_2$.

After 15 days some of the cells were fixed for analysis with a 4% formaldehyde/PBS solution for 10 min at room temperature and subsequently permeabilized for 5 min with 0.1% Triton X-100 in 4% formaldehyde/PBS. After two brief washes with PBS, unspecific antibody binding was blocked by a 30 min incubation with 5% normal goat serum in PBS. Then primary antibodies were added in 5% normal goat serum/PBS as follows: Mouse anti-Nkx2.5 (1:50), anti-Brachyury (1:50), anti-Gata4 (1:20), anti-CXCR4 (1:100), and anti-troponin I (1:100). After a 2 h incubation the cells were washed 4 times for 5 min each with 0.1% Tween/PBS. Appropriate fluorescence-tagged secondary antibody was used for visualization; Goat anti-mouse 546 (1:200, invitrogen), anti-rabbit Alexa 488 (1:200), and anti-goat Alexa Fluor 546 (1:200) prepared in 5% normal goat serum/PBS was used. After incubation for one hour, cells were washed in 0.1% Tween/PBS three times for 5 min each. The DNA stain Hoechst33342 (Invitrogen) was used as a marker of nuclei (dilution 1:5000 in PBS, 10 min incubation). Fluorescence images were taken with a Cellomics ArrayScan HCS Reader microscopy system. To determine the morphology and certain markers of cardiac stem cells, random fields were selected and analyzed by the Cellomics ArrayScan HCS software (the number of cells was determined by counting Hoechst stained nuclei). The 'pCMV6-XL4-Nkx-2.5, pCMV6-XL5-Mesp1, pCMV6-XL5-brachyury' transfected cells showed better expression of the Cardiac stem cell lineage markers Gata4, Nkx2.5, CXCR4, Brachyury, and Troponin1, as well as cells grown on the Laminin-211 coated plates. Similar results were obtained for cells transfected with pCMV-MSI1-2A-Ngn2 and pCMV6-XL5-MBD2 using the identical methods/protocol of this Example 6 showing that CSLC can be obtained through the NSLC pathway by differentiation towards neural crest-like cells and then into CSLC by the appropriate conditions and reprogramming factors.

Characterization of the cardiac stem-like cells was performed using a cardiomyocyte gene-array containing 48 partial cDNAs coding for these genes and controls. RNA was isolated from samples using QIAshredder (Qiagen) and RNeasy Plus mini Kit (Qiagen) as per manufacturer's instructions. DNase I treatment was performed on the RNeasy Column to further remove the transfected plasmid DNA using Rnase-Free DNase Set (Qiagen). RNA was eluted in 35 μl of RNase-free water. Before cDNA synthesis, all RNA samples were quantified using the NanoDrop 1000 (ThermoScientific). cDNA was prepared using the High Capacity cDNA archive kit (Applied Biosystems) as per the manufacturer's instructions. 400 ng of RNA was used in each 50 μl RT reaction. The resulting cDNA samples were used immediately for TLDA analysis (1 TLDA was prepared for 4 samples) in an Applied Biosystems 7900HT Fast Real-time PCR system. Thermal cycler conditions were as follows: 2 minutes at 50° C., 10 minutes at 94.5° C., and 30 seconds at 97° C., 1 minute at 59.7° C. for 40 cycles. Relative Expression values were calculated using the Comparative C$_T$ method using the formula $2^{-\Delta\Delta C_T}$ and shown in Table 1. Table 1: Gene array results comparing relative expression levels of select genes between cardiac stem-like cells, floating cardiosphere stem-like cells, and fetal cardiomyocytes. Gene array on the stem-like cells was performed on samples after four weeks of transfection with Mesp1/Tbx5/brachyury. Expression values given relative to the starting untransfected human Mesenchymal Stem Cells (MSC).

TABLE 1

Gene array results comparing relative expression levels of select genes between cardiac stem-like cells, floating cardiosphere stem-like cells, and fetal cardiomyocytes. Gene array on the stem-like cells was performed on samples after four weeks of transfection with Mesp1/Tbx5/brachyury. Expression values given relative to the starting untransfected human Mesenchymal Stem Cells (MSC).

| | | | Relative expression to MSC Control | | |
| --- | --- | --- | --- | --- | --- |
| Symbol | Common name and description | Company Gene ID | Adherent Cardiac Stem-Like Cells | Cardiosphere Stem-Like Cells | Human fetal cardiomyocytes |
| ACTN2 | Actinn, alpah2 | NM_001103 | 38.96 | 27.91 | 274.14 |
| MYH7 | Myosin, heavy chain 7 cardiac muscle beta | NM_000257 | 102.30 | 24.38 | 99.96 |
| SLC8A1 | Sodium/Calcium exchanger | NM_021097 | 1.77 | 6.17 | 3.81 |
| ADRB1 | Adrenergic beta-1 receptor | NM_000684 | 311.55 | 285.19 | 1205.91 |

TABLE 1-continued

Gene array results comparing relative expression levels of select genes between cardiac stem-like cells, floating cardiosphere stem-like cells, and fetal cardiomyocytes. Gene array on the stem-like cells was performed on samples after four weeks of transfection with Mesp1/Tbx5/brachyury. Expression values given relative to the starting untransfected human Mesenchymal Stem Cells (MSC).

| Symbol | Common name and description | Company Gene ID | Relative expression to MSC Control | | |
|---|---|---|---|---|---|
| | | | Adherent Cardiac Stem-Like Cells | Cardiosphere Stem-Like Cells | Human fetal cardiomyocytes |
| MYL2 | Myosin light chain 2 | NM_000432 | 3.73 | 2.55 | 29.07 |
| TNN3 | Troponin I type 3 (cardiac) | NM_000363 | 2.79 | 2.70 | 9.65 |
| CKM | Creatine kinase muscle | NM_001824 | 0.41 | 0.75 | 0.97 |
| MYL3 | Myosin light chain 3 ventricular | NM_000258 | 15.17 | 2.91 | 9.95 |
| TNNT2 | Troponin T type 2 (cardiac) | NM_000364 | 5.20 | 4.03 | 9.72 |
| DES | Desmin | NM_001927 | 9.58 | 31.06 | 114.15 |
| GATA4 | GATA binding protein 4 | NM_002052 | 68.86 | 2.64 | 532.67 |
| NKX2-5 | NK2 homeobox 5 | NM_004387 | 9.48 | 3.20 | 23.14 |
| NPPA | Natriuretic peptide A | NM_006172 | 2.78 | 14.61 | 85.94 |
| HAND2 | Heart and neural crest derivatives expressed 2 | NM_021973 | 10.08 | 3.58 | 43.81 |

Quantitative comparison of cardiomyocytes gene expression was analyzed by using a significance analysis algorithm to identify genes that were reproducibly found to be enriched in reprogrammed cells compared to untransfected starting cells (the MSC; see Table 1). The TLDA data (Table 1) revealed a remarkable increase in specific markers for cardiac lineage in reprogrammed adherent or floating cells, such as ACTN2, MYH7, ADRB1, MYL3, Desmin, GATA4, and HAND2. There was also a difference in the gene expression pattern between adherent and floating reprogrammed cells. After the transfection with Mesp1/Tbx5/Brachyury, the expression of Myosin heavy chain 7 (MYH7, 102.30 fold), Myosin light chain 3 (MYL3, 15.17 fold), Gata 4 (68.86 fold), HAND2 (10.08 fold) and Nkx2.5 (9.48 fold) was markedly more increased in adherent cardiac stem-like cells as compared to cells cultured in suspension as cardiospheres (Table 1), indicating a potentially more differentiated state of the adherent cardiac stem-like cells compared to the floating cardiospheres. Natriuretic peptide A (NPPA) was more highly expressed in the floating cardiospheres than adherent cardiac stem-like cells.

Example XXXVI: Formation of Floating Colonies and Cell Differentiation

To investigate whether a single Cardiac Stem-Like Cell (CSLC) is able to generate a cardiosphere, CSLC were dissociated into single cells and cultured in cardiac stem cell medium (RPMI 1640: Glutamax 100× supplemented with Activin A (R&D Systems, 30 ng/ml), NEAA (Invitrogen, 1×), ITS (Invitrogen, 1×), bFGF (Invitrogen, 20 ng/ml), BMP4 (R&D Systems, 20 ng/ml), NRG (Peprotech, 10 ng/ml)) in a low-bind cell culture dish (Corning), and cardiosphere formation was monitored by taking bright field images using light microscope (Nikon, 10×) over several days. The CSLC started to proliferate and grew Into a cardiosphere that continuously grew in size and volume.

In order to determine the differentiation potential of CSLC to differentiate into Cardiomyocyte-Like Cells (CLC), the medium was additionally supplemented with Oxytocin (5 µM, R&D Systems), T3 ($10^{-4}$M), and Cardiotropin (20 ng/ml) for two weeks. After two weeks in culture, the cells were stained for early cardiac markers such as Brachyury, Nkx2.5 and late markers of cardiac cells such as Troponin T, Troponin I, and Connexin-43. Immunohistochemistry analysis on Day 30 revealed that the cells stained positive for all 5 markers indicating the cardiac phenotype of these cells. CLC differentiated from cardiosphere-CSLC generally had higher expression levels of all the markers than CLC differentiated from adherent CSLC.

Patent Literature Cited

Bhasin, Vishal. 2010. Method of Producing Progenitor Cells from Differentiated Cells. PCT/AU2010000120.

Cifarelli R A, Cellini F, Liddo R D, Pamigotto et al., 2010. Method For the Production of Multicomponent Stem Cells, Relative kits and Used in the Medical Field. US 2010/0003223A1.

Kremer B K F, Fandrich F, 2006. Dedifferentiated, Programmable Stem Cells of Monocytic Origin, and Their Production and Use. U.S. Pat. No. 7,138,257 B2.

Winner G F. Newson B S, Rill D R, and Williams Jim C. 2010. Monocyte-Derived Stem Cells. US2010/0047908A1

Bennett D et al. 2009 Stem-Like Cells and Method for Reprogramming Adult Mammalian Somatic Cells. Wo/2009/079007.

Akamatsu W, Okano H. Method for Producing Neural Stem Cells. Wo/2010/052904.

You, S, Moon J H, Yoon B S, Kim K D, Park G, Jun E K, Kim B, Yoo, S J, Kwak S S, Maeng I. 2007. Dedifferentiation d'Astrocytes en Cellules Souches Neuronales au Moyen du Gene BMI-1. (WO/2007/097494).

You, S, Moon J H, Yoon B S, Kim D, Park G, Jun E K, Kim B, Yoo, S J, Kwak S S, Maeng I. 2009. De-Differentiation of Astrocytes into Neural Stem Cell using Nanog. US2009/0246870A1.

Chen S, Ding S, Schltz P G. Compositions and Methods for Inducing Cell Dedifferentiation. US2005/0176707A1.

You S, et al., 2009. De-Differentiation of Astrocytes into Neural Stem Cells using SHH. Us 2009/0227023.

Oliveri, R and Andersen, C Y. 2009. Method for Increasing the Plasticity Level of a Cell. WO/2009/018832.

Imai T, Tokunaga A, Yoshida T, Mikoshiba K, Nakafuku M, Okana H. Num Protein. 2004. Expression Inhibitor making Use Musashi. Us 2004/0054140A1.

Okano, H. 2003. RNA-Binding Protein Musahi 2. WO03/016531.

Scientific Publication Literature Cited

Takahashi K, Tanabe K, Ohnuki M, Narita M, Ichisaka T, Tomoka K, Yamanaka S. Induction of pluripotent stem cells from adult human fibroblasts by defined factors. Cell. 2007 Nov. 30; 131(5):861-72.

Okita K, Hong H, Takahashi K, Yamanaka S. Generation of mouse-induced pluripotent stem cells with plasmid vectors. Nat Protoc. 2010; 5(3):418-28.

Yu J, Hu K, Smuga-Otto, Tian S, Stewart R, Slukvin I I, Thomson J A. Human induced pluripotent stem cells free of vector and transgene sequences. Science 2009 8; 324 (5928):797-801.

Zeitlow R, Lane E L, Dunnet S B, Rosser A E. Human stem cells for CNS repair. Cell Tissue Res. 2008; 331(1):301-22.

Singec I, Jandial R, Crain A, Nikkhah G, and Snyde E. Y. The Leading Edge of Stem Cell Therapeutics. Annual Review of Medicine 2007:58; 313-328.

Mimeault, M., Hauke, R. & Batra, S. K. 2007. Stem cells: a revolution in therapeutics-recent advances in stem cell biology and their therapeutic applications in regenerative medicine and cancer therapies. Clin Pharmacol Ther, 82, 252-64.

Levesque, M F and Neuman T. Transdiffentiation of transfected epidermal basal cells into neural progenitor cells, neuronal cells and/or glial cells. Patent, filling date 2000.

Shea T B. Neuritogenesis in mouse NB2a/d1 neuroblastoma cells: triggering by calcium influx and involvement of actin and tubulin dynamics. Cell Biol Int Rep. 1990; 14(11):967-79.

Yeomans N D, Trier J S, Moxey P C, and Markezin E T. Maturation and differentiation of cultured fetal stomach. Effects of corticosteroids, pentagastrin, and cytochalasin B. Gasteroenterology 1976; 71(5):770-7.

Paterson F C, Rudland P S. Microtubule-disrupting drugs increase the frequency of conversion of a rat mammary epithelial stem cell line to elongated, myoepithelial-like cells in culture. J Cell Physiol. 1985; 125(1):135-50.

Bouwens L. Transdifferentiation versus stem cell hypothesis for the regeneration of islet beta-cells in the pancreas. Micro Res Tech. 1998; 43(4):332-6.

Bouwens L. Cytokeratins and cell differentiation in the pancreas. J Pathol. 1998b; 184(3):234-9.

Theise N D, Nimmakayalu M, Gardner R, Illei P B, Morgan G, Teperman L, Henegariu O, Krause D S. Liver from bone marrow in humans. Hepatology 2000; 32(1):11-6.

Woodbury D, Schwarz E J, Prockop D J, Black I B. Adult rat and human bone marrow stromal cells differentiate into neurons. J Neurosci Res. 2000; 61(4):364-70.

Brunet, J F; Ghysen, A. Deconstructing cell determination: proneural genes and neuronal identity. Bioessays. 1999; 21:313-318.

Bertrand N, Castro D S, and Guillemot F. Proneural genes and the specification of neural cell types. Nat Rev Neurosci. 2002; 3(7):517-30.

McCormick M B, Tamimi R M, Snider L, Asakura A, Bergstrom D, Tapscott S J. NeuroD2 and neuroD3: distinct expression patterns and transcriptional activation potentials within the neuroD gene family. Mol Cell Biol. 1996; 16(10):5792-800.

Guillemot F, Lo L C, Johnson J E, Auerbach A, Anderson D J, Joyner A I. Mammalian achaete-scute homolog 1 is required for the early development of olfactory and autonomic neurons. Cell 1993; 75(3):463-76.

Fode C, Gradwohl G, Morin X, Dierich A, LeMeur M, Goridis C, Guillemot F. The bHLH protein NEUROGENIN 2 is a determination factor for epibranchial placode-derived sensory neurons. Neuron 1998; 20(3):483-94.

Fernandes K J L, McKenzie I A, Mill P, Smith K M, Akhavan M, Bamabé-Heider F, Biemaskie J, Junek A, et al. A dermal niche for multipotent adult skin-derived precursor cells. Nature Cell Biology 2004; 6:1082-1093.

Jacobsen F, Hirsch T, Mittler D, Schulte M, Lehnhardt M, Druecke D, Homann H H, Steinau H U, Steinstraesser L. Polybrene improves transfection efficacy of recombinant replication-deficient adenovirus in cutaneous cells and burned skin. J Gene Med. 2006; 8(2):138-46.

Keams C M, Gash D M. GDNF protects nigral dopamine neurons against 6-hydroxydopamine in vivo. Brain Res. 1995; 672 (1-2):104-11.

Gash D M, Zhang Z, Ovadia A, Cass W A, Yi A, Simmerman L, Russel D, Martin D, Lapchak P A, Collins F, Hoffer B J, Gerhardt G A. Functional recovery in parkinsonian monkeys treated with GDNF. Nature 1996; 380(6571): 252-5.

Lindner M D, Winn S R, Baetge E E, Hammang J P, Gentile F T, Doherty E, McDermott P E, Frydel B, Ullman M D, Schallert T et al. Implantation of encapsulated catecholamine and GDNF-producing cells in rats with unilateral dopamine depletions and parkinsonian symptoms. Exp Neurol. 1995; 132(1):62-76.

Kordower J H, Emborg M E, Bloch J, Ma S Y, Chu Y, Leventhal L, McBride J, Chen E Y, Palfi S, Roitberg B Z, Brown W D, Holden J E, et al. Neurodegeneration prevented by lentiviral vector delivery of GDNF in primate models of Parkinson's disease. Science 2000; 290(5492): 767-73.

Martinez-Serrano A, Bjorklund A. Immortalized neural progenitor cells for CNS gene transfer and repair. Trends Neurosci. 1997; 20(11):530-8.

Chambers S M, Fasano C A, Papapetrou E P, Tomishima M, Sadelain M, Studer L. Highly efficient neural conversion of human ES and iPS cells by dual inhibition of SMAD signaling. Nat Biotechnol. 2009; 27(3):275-80.

Headings are included herein for reference and to aid in locating certain sections These headings are not intended to limit the scope of the concepts described therein under, and these concepts may have applicability in other sections throughout the entire specification Thus, the present invention is not intended to be limited to the embodiments shown herein but is to be accorded the widest scope consistent with the principles and novel features disclosed herein.

It is understood that the examples and embodiments described herein are for illustrative purposes only and that various modifications or changes in light thereof will be suggested to persons skilled in the art and are to be included within the present invention and scope of the appended claims.

SEQUENCE LISTING (515 sequences)

SEQ ID NO: 1 - DNA, 996 bp, Homo sapiens
aatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaaaa

SEQ ID NO: 2 - protein, 175 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 3 - DNA, 763 bp, Homo sapiens
agaaacatccagaatacatttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataagagatgatagaaaaaagccttcacttcaaagaagtcaaatttcatgaagaaaacctctggcacattgacaaatactaaatgtgcaagtatatagattttgtaatattactatttagtttttttaatgtgtttgcaatagtcttattaaaataaatgttttttaaatctgagactgaaaaaaaaaaaaaa

SEQ ID NO: 4 - protein, 166 aa, Homo sapiens
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 5 - DNA, 1303 bp, Homo sapiens
caagagcgcgggcggcgaggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaagggaaagtggaaaaataaggaacggattctcatcttttcttccagaggaataaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatcagttaaaaaaaaaaaaaaaaaaaaaaaaaaaaaaaa

SEQ ID NO: 6 - protein, 353 aa, Homo sapiens
MAATKRKRRGGFAVQAKKPKRNEIDAEPPAKRHATAEEVEEEERDRIPGPVCKGKWKNKERILIFSSRGINFRTRHLMQDLRMLMPHSKADTKMDRKDKLFVINEVCEMKNCNKCIYFEAKKKQDLYMWLSNSPHGPSAKFLVQNIHTLAELKMTGNCLKGSRPLLSFDPAFDELPHYALLKELLIQIFSTPRYHPKSQPFVDHVFTFTILDNRIWFRNFQIIEEDAALVEIGPRFVLNLIKIFQGSFGGPTLYENPHYQSPNMHRRVIRSITAAKYREKQQVKDVQKLRKKEPKTLLPHDPTADVFVTPAEEKPIEIQWVKPEPKVDLKARKKRIYKRQRKMKQRMDSGKTK

SEQ ID NO: 7 - DNA, 969 bp, Homo sapiens
agctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaa

SEQ ID NO: 8 - protein, 138 aa, Homo sapiens
MPNFSGNWKIIRSENFEELLKVLGVNVMLRKIAVAAASKPAVEIKQEGDTFYIKTSTTVRTTEINFKVGEEFEEQTVDGRPCKSLVKWESENKMVCEQKLLKGEGPKTSWTRELTNDGELILTMTADDVVCTRVYVRE

SEQ ID NO: 9 - DNA, 1088 bp, Homo sapiens
ggagcgggaggcggggccacttcaatcctgggcaggggcggttccgtacagggtataaaagctgtccgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaaaaaaaaaaaaaaaaaaaaaaaaaaaaaaaa

SEQ ID NO: 10 - DNA, 1075 bp, Homo sapiens
gattcaagtgctggctttgcgtccgcttccccatccacttactagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaaaaaaaaaaaaaaaaaaaaaaaaaaaaaaaa

SEQ ID NO: 11 - DNA, 4392 bp, Homo sapiens
atgaagggagacaccaggcatctcaatggagaggaggacacccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctaaaaaaaaaaaaaaaaaa

SEQ ID NO: 12 - protein, 853 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 13 - DNA, 4293 bp, Homo sapiens
acccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctaaaaaaaaaaaaaaaaaa

SEQ ID NO: 14 - protein, 833 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 15 - DNA, 4104 bp, Homo sapiens
acccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctaaaaaaaaaaaaaaaaaa

SEQ ID NO: 16 - protein, 770 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 17 - DNA, 4267 bp, Homo sapiens
gaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctaaaaaaaaaaaaa

SEQ ID NO: 18 - protein, 845 aa, Homo sapiens
MEPSPEPPSLESMKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 19 - protein, 724 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNS

SEQ ID NO: 20 - protein, 792 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKDLWLSCALHRRVQHGPWCPPEAAGKVLERACHPTPLRPSEGLLCM

SEQ ID NO: 21 - protein, 694 aa, Homo sapiens
MKGDTRHLNGEEDAGGREDSILVNGACSDQSSDSPPILEAIRTPEIRGRRSSSRLSKREVSSLLSYTQSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 22 - protein, 728 aa, Homo sapiens
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPASLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRIFGFPVHYTDVSNMGRGARQKLLGRSWSVPVIRHLFAPLKDYFACE

SEQ ID NO: 23 - DNA, 1393 bp, Homo sapiens
agccctttgtttatggcctgatctagctaaggcttctagacttcaggagcttaagaatcgtccggagggctgggcgtggcggtgcaggcctgtagtcccacccactccgaaggctgcggagggaggatcaacttgagtctgggaactcagccaggaattcaagaccagcctgggcaacacagtgaggccccctacccacatcctctccgtccccgcaatctccttccatcccagggtgttgctgaaaatgtcagatgcaaatttggatagcagcaagaagaatttcttggagggggaagtagatgatgaggaaagtgtgattttgacactggtgccagttaaagatgacgcaaatatggaacaaatggaaccaagcgtttcttcaacttctgatgtcaaactggagaagcctaagaaatacaatccaggtcatctacttcaaacaaatgagcaatttacagctccacaaaaagctagatgcaaaataccagcccttcccttgccgaccattttgcctcccattaataaggtgtgtcgggacactttgcgggactggtgtcaacaactcggtttgagtactaatggcaagaaaatcgaagtttatctgaggcttcataggcatgcttaccctgaacaacggcaagatatgcctgaaatgtcacaagagaccagattacagcgatgttcgaggaaacgcaaggcagtgaccaagagagcaaggcttcagagaagttatgagatgaatgagagagcagaagagaccaatacagttgaagtgataacttcagcaccgggagccatgttggcatcatgggcaagaattgctgcaagagctgttcagcctaaggctttgaattcatgttccattcctgtttctgttgaggcctttttgatgcaagcctctggcgtcaggtggtgtgtggtccatggcagacttctctcggcagacacaaagggttgggtacgcctgcagtttcatgcaggtcaggcctgggtgcctaccactcacaggaggatgatttctctcttcttgttacctgcctgcattttcccatccccaggcatagaagataatatgttatgccccgactgtgctaagaggaataagaagatgatgaaaagattaatgacagtagagaagtagcagcaacctgtttgaatacaatgtactaaaggagggatgtactttcagatcatgtaacctattacgaaggagtggaagaggagacaatttgaatgaatcctcatgatctacaaaacaaaatcatagtgactaggactccacagtgaagatggttgactagtgacacagccccatctaaagaatccctttctgtatgtctgaaaacccattaaaataaagtcactgcaattggccttgtaaaaaaaaaaa

SEQ ID NO: 24 - protein, 298 aa, Homo sapiens
MSDANLDSSKKNFLEGEVDDEESVILTLVPVKDDANMEQMEPSVSSTSDVKLEKPKKYNPGHLLQTNEQFTAPQKARCKIPALPLPTILPPINKVCRDTLRDWCQQLGLSTNGKKIEVYLRLHRHAYPEQRQDMPEMSQETRLQRCSRKRKAVTKRARLQRSYEMNERAEETNTVEVITSAPGAMLASWARIAARAVQPKALNSCSIPVSVEAFLMQASGVRWCVVHGRLLSADTKGWVRLQFHAGQAWVPTTHRRMISLFLLPACIFPSPGIEDNMLCPDCAKRNKKMMKRLMTVEK

SEQ ID NO: 25 - DNA, 1079 bp, Homo sapiens
tggagctccggttttcagcctctttccgggctacctggtagcaatttgaggctctgtcatcagtttctgctacgtttcaaagatcctggagaagcctagtgttgtgtcaagacgccgatggacccatcacagtttaatccaacctacatcccagggtctccacaaatgctcaccgaagaaaattcccgggacgattcaggggcctctcaaatctcctccgagacgttgataaagaaccttagtaacttgactatcaacgctagtagcgaatctgtttcccctctatcggaagctttactccgtcgagagtctgtaggagcagcagtcctcagggaaatcgaagatgagtggctttacagcaggagaggagtaagaacattgctgtctgtgcagagagaaaagatggcaagattgagatacatgttactcggcggagttcgtacgcatgaaagaagaccaacaaacaaggagcctaagggagttaagaaggaatcaagaccattcaaatgtccctgcagtttctgcgtgtctaatggatgggatccttctgagaatgctagaatagggaatcaagacaccaagccacttcagccataaatcttattcttgcacctttttttcttggtagtaattttatatagcaggttgagaaagctactctatgctagtatagactatacaccaataattttgataatgagttctaggatgtatttttcttgtatctttttcttcctactatgatactagtaattcataagggatctgtgtaatctgaatgtatttgaataactttagctctactgtttgatttgacccaaagaagccaagatgatataagtattcccatgtgtcttagaagcccaaagtcagtgagatgaaacccaacatcaagaaattgaagcaaagttacttatggataaagaaagcattaggtagttgggctatagcataattagattttctggctttcaaaaatttggattgcaatcacagcaaactttgttatttttacagttttcagtacaaaagtgtttatatagaaacaataaagttgacatttgagtaccttttaaaaa

SEQ ID NO: 26 - protein, 159 aa, Homo sapiens
MDPSQFNPTYIPGSPQMLTEENSRDDSGASQISSETLIKNLSNLTINASSESVSPLSEALLRRESVGAAVLREIEDEWLYSRRGVRTLLSVQREKMARLRYMLLGGVRTHERRPTNKEPKGVKKESRPFKCPCSFCVSNGWDPSENARIGNQDTKPLQP

SEQ ID NO: 27 - DNA, 2823 bp, Homo sapiens
aagtgggaggagactttgcaaatagcaatcttggggcaggggccattttggaagcatgttgcgaggctccgcttcttctacaagtatggagaaggcaaaaggcaaggagtggacctccacagagaagtcgagggaagaggatcagcaggcttctaatcaaccaaattcaattgctttgccaggaacatcagcaaagagaaccaaagaaaaaatgtctatcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcctgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgccgttggttgttggtggtcagaattattgtgtaataaataatagacattttttcttatactatgtgtattgttccttttgtttcctttttaaacttctcccctgctttatttggatgggtcaagtttctgttctgtttccttcctttctattaatttggaaatgtccttggctttacgattctgcttgtagatacttcccctgcttctaacacatttcaataaacttaaatttctctatatacaaaataaattaataattggagtctaccaaaaaaa

SEQ ID NO: 28 - protein, 304 aa, Homo sapiens
MLRGSASSTSMEKAKGKEWTSTEKSREEDQQASNQPNSIALPGTSAKRTKEKMSIKGSKVLCPKKKAEHTDNPRPQKKIPIPPLPSKLPPVNLIHRDILRAWCQQLKLSSKGQKLDAYKRLCAFAYPNQKDFPSTAKEAKIRKSLQKKLKVEKGETSLQSSETHPPEVALPPVGEPPALENSTALLEGVNTVVVTTSAPEALLASWARISARARTPEAVESPQEASGVRWCVVHGKSLPADTDGWVHLQFHAGQAWVPEKQEGRVSALFLLPASNFPPPHLEDNMLCPKCVHRNKVLIKSLQWE

SEQ ID NO: 29 - DNA, 612 bp, Homo sapiens
ataagatgggaactctcccggcacgtagacatatcccgccgtgggtgaaagttcccgaagacctgaaagatccagaggtgttccaggtccagacgcggctgctgaaagccattttcggcccggacggatctcgaatcccttacatcgagcaggtgagcaaggccatgctcgagctgaaggctctggagtcttcagacctcaccgaggtcgtggtttacggctcctatttgtacaagctccggaccaagtggatgctccagtccatggctgagtggcaccgccagcgccaggagcgagggatgctcaaacttgccgaagccatgaatgccctcgaactaggcccttggatgaagtgaaccagtttccagccaatgcaatgaagccgggttgcagagattaggttgtggccagagctagagtgattccttaagcttgttttaaaatctgctccagcctaaagagttaagggaaaaccatttgttcccttaaagagttaagggaaaacccttggctctgagtcttgttgtgaatatttctttgatgattgttaataaaaagtgttttttcttttttcccatttttaaaaataacaataaagttttaaataagttg

SEQ ID NO: 30 - protein, 116 aa, Homo sapiens
MGTLPARRHIPPWVKVPEDLKDPEVFQVQTRLLKAIFGPDGSRIPYIEQVSKAMLELKALESSDLTEVVVYGSYLYKLRTKWMLQSMAEWHRQRQERGMLKLAEAMNALELGPWMK

SEQ ID NO: 31 - DNA, 2078 bp, Homo sapiens
atgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttcggcgcttacagcctggcggcggcggccggcgccgcgggaccctacggccgcccctacggcctgcaccctgcggcggcggccggtgcctattcgcacccggcagcggcggcggccgcggctgctgcggcggcgctccagtacccgtacgcgctgccgccggtggcaccggtgctgcctcccgctgtgccgctgctgccctcgggcgagctgggccgcaaagcggccgccttcggctcacagctcggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccacccaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagtaccgtggggatgggagggaaattctttgtatatatttgtaaaaaaattattgactttccttttggggtttttatttttttaagaaaaaacaaattccgtagatttagagctctgaactttcattttttttgaaggttcactctccgaagttttatctgagaaaagaatgtatagagacgttgggagattttaaatataaaaaattttcaaaaaggcaaaaagtgtcattctattataaaagtctgtttatatatgaatgaatatatatggtattctaaatgttattccatcgtgttgtacacaactttgtaaataaatttttaaaatgccaaaaaaaaaa

SEQ ID NO: 32 - protein, 478 aa, Homo sapiens
MTLSGGGSASDMSGQTVLTAEDVDIDVVGEGDDGLEEKDSDAGCDSPAGPPELRLDEADEVPPAAPHHGQPQPPHQQPLTLPKEAAGAGAGPGGDVGAPEADGCKGGVGGEEGGASGGGPGAGSGSAGGLAPSKPKNSLVKPPYSYIALITMAILQSPQKKLTLSGICEFISNRFPYYREKFPAWQNSIRHNLSLNDCFVKIPREPGNPGKGNYWTLDPQSEDMFDNGSFLRRRKRFKRHQQEHLREQTALMMQSFGAYSLAAAAGAAGPYGRPYGLHPAAAAGAYSHPAAAAAAAAAAALQYPYALPPVAPVLPPAVPLLPSGELGRKAAAFGSQLGPGLQLQLNSLGAAAAAAGTAGAAGTTASLIKSEPSARPSFSIENIIGGGPAAPGGSAVGAGVAGGTGGSGGGSTAQSFLRPPGTVQSAALMATHQPLSLSRTTATIAPILSVPLSGQFLQPAASAAAAAAAAAQAKWPAQ

SEQ ID NO: 33 - DNA, 2193 bp, Homo sapiens
gttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccactcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaaaaaaaaaaaa

SEQ ID NO: 34 - protein, 365 aa, Homo sapiens
MGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPLPSSERPLWPLCPLPGPTRVEGETVQGGAIGPSTLSPEPRAWPLHLLQGTAVPGGRSSGGHRASLWGQLPTSYLPIYTPNVVMPLAPPPTSCPQCPSTSPAYWGVAPETRGPPGLLCDLDALFQGVPPNKSIYDVWVSHPRDLAAPGPGWLLSWCSL

SEQ ID NO: 35 - DNA, 5783 bp, Homo sapiens
gctccgggccagcgcggcggcggcggcggcggcggcagcagcaggagcagccccggctgcgggtcgcgacggcggcggggcgccccctcccccgtgccggggcgcggcggagggatgtggggccttgcgggaggaaggcttttcggcatcttctcggccccggtgctggtggctgtggtgtgctgcgcccagagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaa

SEQ ID NO: 36 - protein, 473 aa, Homo sapiens [sequence omitted]

SEQ ID NO: 37 - DNA, 5783 bp, Homo sapiens; identical to SEQ ID NO: 35

SEQ ID NO: 38 - protein, 473 aa, Homo sapiens
MCSGLLELLLPIWLSWTLGTRGSEPRSVNDPGNMSFVKETVDKLLKGYDIRLRPDFGGPPVCVGMNIDIASIDMVSEVNMDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 39 - DNA, 5581 bp, Homo sapiens
agagctgggctgttactggatatatgccatgtgagctggatggcctgtgaaagagaaaggcagttggtgataaaaataattggatgattcttaaagaaatagaagagacttgctgttggcagtgagaacccacaagaggcctctaaggagatgattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaa

SEQ ID NO: 40 - protein, 402 aa, Homo sapiens
MWATYQTEEDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 41 - DNA, 5543 bp, Homo sapiens
agtcacaacttccggttagcgtggcggaggctctcggagtctttgggacctcagcaccgggataccgggagactccctcgtgtccccatgtgggccacctaccagacagaagaggattataccttaaccatgtattttcaacaatattggagagataaaaggctcgcctattctgggatccctctcaacctcacgcttgacaatcgagtggctgaccagctatgggtgcccgacacatatttcttaaatgacaaaaagtcatttgtgcatggagtgacagtgaaaaaccgcatgatccgtcttcaccctgatgggacagtgctgtatgggctcagaatcaccacgacagcagcatgcatgatggacctcaggagataccccctggacgagcagaactgcactctggaaattgaaagctatggctacaccacggatgacattgagttttactggcgaggcggggacaaggctgttaccggagtggaaaggattgagctcccgcagttctccatcgtggagcaccgtctggtctcgaggaatgttgtcttcgccacaggtgcctatcctcgactgtcactgagctttcggttgaagaggaacattggatacttcattcttcagacttatatgccctctatactgataacgattctgtcgtgggtgtccttctggatcaattatgatgcatctgctgctagagttgccctcgggatcacaactgtgctgacaatgacaaccatcaacacccaccttcgggagaccttgcccaaaatcccctatgtcaaagccattgacatgtaccttatgggctgcttcgtctttgtgttcctggcccttctggagtatgcctttgtcaactacattttctttggaagaggccctcaaaggcagaagaagcttgcagaaaagacagccaaggcaaagaatgaccgttcaaagagcgaaagcaaccgggtggatgctcatggaaatattctgttgacatcgctggaagttcacaatgaaatgaatgaggtctcaggcggcattggcgataccaggaattcagcaatatcctttgacaactcaggaatccagtacaggaaacagagcatgcctcgagaagggcatgggcgattcctgggggacagaagcctcccgcacaagaagacccatctacggaggaggtcttcacagctcaaaattaaaatacctgatctaaccgatgtgaatgccatagacagatggtccaggatcgtgtttccattcactttttctcttttcaacttagtttactggctgtactatgttaactgagtgactgtacttgatttttcaaagacttcatttaacactgagtgaaatattactctgcctgtcaagtttttatacctgtacacacacagacacacaagcagacacacacatatatacatacgcaattgtatatatatgtgaactttctcagcatatatataaaatacacgtgtatatgaggatgtatgtgtatatgtttatacacacaggagtcagtgcccatgtgtatggaagacaaatacacatacatatatacattttgcagctatggacaatttaccacaggatgcatattaaagaaagtcatagtttttttcttttttaattgaaagggacaagtatcatctaaatattatgccttgagaatgagggcgtgaaacacaatatcatccccaaatgtgtcttgtattatcataagttagatgttttagtttaaaaatcagaaagacattcttagttaatctttgaaaactcatacagtggtattgctagtttaaaatgagtcacttacttcatatcctctcgttcagtttagtaagcaaaggcttcttggcttctctggtgatggggtttgttttcatcgggcatacgttttctgcaatggtttagtggctggggtgagccactggcagtgtgcttacctgttgtctgaaacatagatagatcccacgttgatgtctgaacgaccgtcttttgaaaactcatcgggagtgaatggcatctcgttgtaagtactctaatatacagtgtgtagtttgtttctgttgttcacttggagtggatccagcttcactgtcatgtgcgaacacagtgacacgtttggccagtgacatttcaatcactgaaaatgtgctctacatctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcacgctagaggcaattacctacttttagacccttttccctctttcattcctatctttttcctcctaatcgctgctctctggttttattttcatctggagactagccagggatttctttggctttggcttttctctgaccattttttccatgggtaacaatgggggatcctaaaagttaaacagattgggaaaaaccttgttaagtggccttatcattattatcatgttaaagaaaaaaaatacatttgcaaagaccttatccctttcaatacttcaggtatctttttctgtatccagtaattaaaggtgtgaggtccacatgcagaagagggaccccaaaatgtaaatggatgtggacaaaaacagtcaatggtctatttaagtgtataatttatactattcagaactgtgacattaattctttctgggagaaaagtgatttaaaacttttttgatgcatagttgaggtacccaaatatcaaaggcagagaccccatggggctccaaagagctgcagtctccttcccaaggttttctggatataaatttgcatggtatagtcataatagcttttgagctttttatatgcatttggcaccaagactgggatccacaactttgtagacactgcgatgaagttaacatattagctatactataaatagtgtttgtaactacacacacacacacacacacacacacaaatacatacatatattctgtaaaaacaaaaaaaaactttttaagatccttgggtatgtgtttgctttactccatttcagaagaaaattacttttcttctaacaaaattattttatagcttctccatttttaaaacttgtgagagcattgagaagagaactctgactgtgttaacagaagagagttgaattggagtctctgttgtgttaaaatgacctctcgttactccacagtagttatttgagccagtgactgagtcgcgttgaggaattctgaacccggacctctgacgttgttgggaggtggctgttacccacacccagacctcttgagtaaggacagaaacgttatcattggggatataatgagatttctttcttaacaattgaaagtaataaagagttaattttctcagtagtcctgtctttccaaaatgcgccacaggggctcaagatctacagaagaatcttgttatgacagtttgttattacccatattcagatatccttgagataatggaagagccctgctacataactccctacagagaaagactgatagacttgagtagtccttaaaacaagtgttattcctgttcaccaaccccgggactgtggaggggtttcactgtctataccatgcgacatccatttcccctgaatctcaaacgaactagaaagtatgtcatgataatatttccattagatttggaagctacctgtacatctgcaatattgtgtttttaacgccagcacccagaactttgacatgttcagtcactccctgaaaggcacttctctcttgtccaaacacagcgttgacatttttactgaggagatcatctcaaaggtgatgccaaacgagtctggggctggttttaaggggacaggcacattgcagttgtaggtgttcattttcagcatctagtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaa

SEQ ID NO: 42 - protein, 388 aa, Homo sapiens
MYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 43 - DNA, 1335 bp, Homo sapiens
gacttttcgcctctcgctggcctctaccgagcgcgtctatgagcgcagcgttcccgccgtcgctgatgatgatgcagcgcccgctggggagtagcaccgccttcagcatagactcgctgatcggcagcccgccgcagcccagccccggccatttcgtctacaccggctaccccatgttcatgccctaccggccggtagtgctgccgccgccgccgccgccgccgcccgcgctgccccaggccgcgctgcagccagcgctgccgcccgcacaccctcaccaccagatccccagcctgcccacaggcttctgctccagcctggcgcagggcatggcgctcacctctacgctcatggccacgctccccggcggcttctccgcgtcgccccagcaccaggaggcggcagcggcccgcaagttcgcgccgcagccgctgcccggcggcggtaacttcgacaaggcggaggcgctgcaggctgacgcggaggacggcaaaggcttcctggccaaagagggctcgctgctcgccttctccgcggccgagacggtgcaggcttcgctcgtcggggctgtccgagggcaagggaaagacgagtcaaaggtggaagacgacccgaagggcaaggaggagagcttctcgctggagagcgatgtggactacagctcggatgacaatctgactggccaggcagctcacaaggaggaagacccgggccacgcgctggaggagaccccgccgagcagcggcgccgcgggcagcaccacgtctacgggcaagaaccggcggcggcggactgccttcaccagcgagcagctgctggagctagagaaggagttccactgcaaaaagtacctctccttgaccgagcgctcgcagatcgcccacgccctcaaactcagcgaggtgcaggtgaaaatctggttccagaaccgacgggccaagtggaaacgggtgaaggcaggcaatgccaattccaagacaggggagccctcccggaaccctaagatcgtcgtccccatccctgtccacgtcagcaggttcgctatcagaagtcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccacaccagaagacacgctaaatatttattatactatcctactttgtacataaatatctctatagactgg

SEQ ID NO: 44 - protein, 348 aa, Homo sapiens
MSAAFPPSLMMMQRPLGSSTAFSIDSLIGSPPQPSPGHFVYTGYPMFMPYRPVVLPPPPPPPPALPQAALQPALPPAHPHHQIPSLPTGFCSSLAQGMALTSTLMATLPGGFSASPQHQEAAAARKFAPQPLPGGGNFDKAEALQADAEDGKGFLAKEGSLLAFSAAETVQASLVGAVRGQGKDESKVEDDPKGKEESFSLESDVDYSSDDNLTGQAAHKEEDPGHALEETPPSSGAAGSTTSTGKNRRRRTAFTSEQLLELEKEFHCKKYLSLTERSQIAHALKLSEVQVKIWFQNRRAKWKRVKAGNANSKTGEPSRNPKIVVPIPVHVSRFAIRSQHQQLEQARP

SEQ ID NO: 45 - DNA, 1224 bp, Homo sapiens
ggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccttcatgcttccctgctggtggtgactctcaaccctgatcagtgccacccttctcggaaaaggagagcagccatccctgtccccaagctttcttgtaagaacctctgccaccgtcaccagctattcattaacttccgggacctgggttggcacaagtggatcattgcccccaaggggttcatggcaaattactgccatggagagtgtcccttctcactgaccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtca

SEQ ID NO: 46 - protein, 364 aa, Homo sapiens
MLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSLHASLLVVTLNPDQCHPSRKRRAAIPVPKLSCKNLCHRHQLFINFRDLGWHKWIIAPKGFMANYCHGECPFSLTISLNSSNYAFMQALMHAVDPEIPQAVCIPTKLSPISMLYQDNNDNVILRHYEDMVVDECGCG

SEQ ID NO: 47 - DNA, 3130 bp, Homo sapiens
gagtcagtggcttgaaacttttaaaagctctgtgctccaagttacaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 48 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 49 - DNA, 2260 bp, Homo sapiens
ttttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaaaaaaaaaaaaaaaaa

SEQ ID NO: 50 - DNA, 2116 bp, Homo sapiens
cgtctccctccctgaagacgtggtcccagccgggtgtcctgacgctcggggttcaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaaaaaaaaaaaaaaaaa

SEQ ID NO: 51 - protein, 532 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 52 - protein, 447 aa, Homo sapiens
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAACSWSGRVSGTPRALSSLCATCRK

SEQ ID NO: 53 - protein, 555 aa, Homo sapiens
MGKWRPGQGHTTGSVKPLSCSDAMELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 54 - protein, 498 aa, Homo sapiens
MELDLSPPHLSSSPEDLCPAPGTPPGTPRPPDTPLPEEVKRSQPLLIPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 55 - DNA, 2285 bp, Homo sapiens
acccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaaaaaaaaaaaaaaaaa

SEQ ID NO: 56 - DNA, 2130 bp, Homo sapiens
agttaagggcctggcgtctccctccctgaagacgtggtcccagccgggtgtcctgacgctcggggttcaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaaaaaaaaaaaaaaaaa

SEQ ID NO: 57 - DNA, 2275 bp, Homo sapiens
aggcaaaccccagccttggactggccctctctgatctctgaggccaggctctaatgtgatttgaatctacttctaaccccttccaagcactgccctcccgaattctctgctcctctccccaccccactgttggtctgtgatttcgaggcaggcgtggccccctgcagcctggaatgaagtcactggggctgtttggagaccggggctgtttggaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaaaaaaaaaaaaaaaaa

SEQ ID NO: 58 - DNA, 2214 bp, Homo sapiens
tgcgggctgcggggagatgtggggagggccccctccactttggagggcagtgaaggagagggatcctctaaattgtcgaggcttcatctctccagattgtatgcccttctcagcaacaccgcctccggccctccgatgggaaagtggaggccgggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacaaaaaaaaaaaaaaaaaaaaaaaa

SEQ ID NO: 59 - DNA, 3153 bp, Homo sapiens
gctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttagcccgcctgcacccaggtgaaataaacagccttgttgctcacacaaagcctgtttggtggtctcttcacacagacgcgcatgaaagggaagacatacaaaaacaaggcctctgaggtaggtactactgagacagccaggtgggaaggactccttggcaaaactccaaccagcctgtacactgggaggaatgtgcactgggatggagccatagaagtttgtgtcgtttgcagtggggaggagcctggtccctcctcttcctgtgaggaacctggaattcaatctgtgaggaacttcttgaaagacccatcaattcttcaatagaaagcatcaaaggacaatttacaccctaagactgaacccctgacctcaaaatctttcccttgctatgttcaccaacctcaacagaaatattaggattcttacctgatcctagccaagccccctccctcatctcccattaaagggtccatcttcaaccaaacttaagtctcaataaatatctggacattgtccttccaactctgggaagctgctaagactctgtccttactgcagaagaaaaaacagccttgtaccctggtcttctcaacaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaaaaaaaaaaaaaaaaa

SEQ ID NO: 60 - protein, 222 aa, Homo sapiens
MTLFSDSARLHPGEINSLVAHTKPVWWSLHTDAHEIWCRDSDRGTSLGRSIPCPPALCSVRKIHLRPQVLRPTSPRNISPISNPVSGLFLLCSPTSLTIPQPLSPFNLGATLQSLPSLNFNSFHSLVETKETCFIREPKTPAPVTDWEGSLPLVFNHCRDASLISRFRPRRDACLGPSPLAASPAFLGQGQVPLNPFSFTLSGKSRFSGAGASTPQPLLLHP

SEQ ID NO: 61 - DNA, 733 bp, Homo sapiens
aaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgaaaaaaaaaaaaaaaaa

SEQ ID NO: 62 - protein, 125 aa, Homo sapiens
MHKEEHEVAVLGPPPSTILPRSTVINIHSETSVPDHVVWSLFNTLFLNWCCLGFIAFAYSVKSRDRKMVGDVTGAQAYASTAKCLNIWALILGILMTIGFILLLVFGSVTVYHIMLQIIQEKRGY

SEQ ID NO: 63 - DNA, 738 bp, Homo sapiens
gaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtgctgctgtgacttcaaaaaaaaa

SEQ ID NO: 64 - protein, 132 aa, Homo sapiens
MNHIVQTFSPVNSGQPPNYEMLKEEQEVAMLGVPHNPAPPMSTVIHIRSETSVPDHVVWSLFNTLFMNTCCLGFIAFAYSVKSRDRKMVGDVTGAQAYASTAKCLNIWALILGIFMTILLIIIPVLVVQAQR

SEQ ID NO: 65 - DNA, 1655 bp, Homo sapiens
gcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaa

SEQ ID NO: 66 - protein, 355 aa, Homo sapiens
MALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHYRKHTGHRPFQCHLCDRAFSRSDHLALHMKRHM

SEQ ID NO: 67 - DNA, 2949 bp, Homo sapiens
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaaaa

SEQ ID NO: 68 - protein, 513 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQGQSRGFVARAGEPCVCWPHFGTHGMMLTPPSSPLELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 69 - protein, 479 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 70 - protein, 429 aa, Homo sapiens
MKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 71 - protein, 118 aa, Homo sapiens
MRQPPGESDMAVSDALLPSFSTFASGPAGREKTLRQAGAPNNSSCHPVPACQRSPSQRGEDDRGPGKGPPPTLVITRAAAKPTQRVPISRHTCEPTQVRNLTTVTGTAVDGNSPAQMN

SEQ ID NO: 72 - protein, 63 aa, Homo sapiens
MRQPPGESDMAVSDALLPSFSTFASGPAGREKTLRQAGAPNNVRNLTTVTGTAVDGNSPAQMN

SEQ ID NO: 73 - DNA, 1587 bp, Homo sapiens
gggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatggagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattctaaaaaaaaaaaaaaaaaaaaaaaaaaaaaaaa

SEQ ID NO: 74 - protein, 366 aa, Homo sapiens
MQPLWLCWALWVLPLASPGAALTGEQLLGSLLRQLQLKEVPTLDRADMEELVIPTHVRAQYVALLQRSHGDRSRGKRFSQSFREVAGRFLALEASTHLLVFGMEQRLPPNSELVQAVLRLFQEPVPKAALHRHGRLSPRSARARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLGDYGAQGDCDPEAPMTEGTRCCRQEMYIDLQGMKWAENWVLEPPGFLAYECVGTCRQPPEALAFKWPFLGPRQCIASETDSLPMIVSIKEGGRTRPQVVSLPNMRVQKCSCASDGALVPRRLQP

SEQ ID NO: 75 - DNA, 1101 bp, Homo sapiens
atgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatggagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccatag

SEQ ID NO: 76 - DNA, 2187 bp, Homo sapiens
gtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttcactctg

SEQ ID NO: 77 - protein, 366 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 78 - DNA, 999 bp, Homo sapiens
atgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccatag

SEQ ID NO: 79 - protein, 332 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 80 - DNA, 4014 bp, Homo sapiens
gtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagttttgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttcttttttttttttttttaaaatggagtctcactgtgtcacccaggctggagtgcagtggcatgatcggctcactgcagcctctgcctcttgggttcaagtgattctcctgcctcagcctcctgagtagctgggatttcaggcacccgccacactcagctaatttttgtatttttagtagagacggggtttcaccatgttgtccaggctggtctggaactcctgacctcaggtgatctgcccaccttggcttcccaaagtgctgggattacaggcatgagccaccatgctgggccaaccatttcttggtgtattcatgccaaacacttaagacactgctgtagcccaggcgcggtggctcacacctgtaatcccagcactttggaaggctgaggcgggcggatcacaaggtcacgagttcaaaactatcctggccaacacagtgaaaccccgtctctactaaaatacaaaaaaattagccgggtgtggtggtgcatgcctttagtcctagctattcaggaggctgaggcaggggaatcgcttgaacccgagaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaactgtca

SEQ ID NO: 81 - protein, 209 aa, Homo sapiens
MGSVSNQQFAGGCAKAAEEAPEEAPEDAARAADEPQLLHGAGICKWFNVRMGFGFLSMTARAGVALDPPVDVFVHQSKLHMEGFRSLKEGEAVEFTFKKSAKGLESIRVTGPGGVFCIGSERRPKGKSMQKRRSKGDRCYNCGGLDHHAKECKLPPQPKKCHFCQSISHMVASCPLKAQQGPSAQGKPTYFREEEEEIHSPTLLPEAQN

SEQ ID NO: 82 - DNA, 2731 bp, Homo sapiens
gcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctcttaaaaaaaaaaaaaaaaaa

SEQ ID NO: 83 - protein, 700 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 84 - DNA, 2098 bp, Homo sapiens
attataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcataggatttttcttgtttggaaaccacgtgttctggtttccatgatgcccatccagtcaatctcatggagggtggagtatggttggagcctaatcagcgaggtttctttttttttttttttcctattggatcttcctggagaaaatactttttttttttttttttttgaaacggagtcttgctctgtcgcccaggctggagtgcagtggcgcggtcttggctcactgcaagctccgtctcccgggttcacgccattctcctgcctcagcctcccgagcagctgggactacaggcgcccgccacctcgcccggctaatattttgtatttttagtagagacggggtttcactgtgttagccaggatggtctcgatctcctgaccttgtgatccacccgcctcggcctccctaacagctgggatttacaggcgtgagccaccgcgccctgcctagaaaagacattttaataaccttggctgccgtctctggctatagataagtagatctaatactagtttggatatctttagggtttagaatctaacctcaagaataagaaatacaagtacaaattggtgatgaagatgtattcgtattgtttgggattgggaggctttgcttattttttaaaaactattgaggtaaagggttaagctgtaacatacttaattgatttcttaccgtttttggctctgttttgctatatcccctaatttgttggttgtgctaatctttgtagaaagaggtctcgtatttgctgcatcgtaatgacatgagtactgctttagttggtttaagttcaaatgaatgaaacaactatttttcctttagttgattttaccctgatttcaccgagtgtttcaatgagtaaatatacagcttaaacat

SEQ ID NO: 85 - protein, 305 aa, Homo sapiens
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 86 - DNA, 2086 bp, Homo sapiens
ataagggctggaggtgctgctttcaggcctggccagcccaccatgcacgcccactgcctgcccttccttctgcacgcctggtgggccctactccaggcgggtgctgcgacggtggccactgcgctcctgcgtacgcgggggcagccctcgtcgccatcccctctggcgtacatgctgagcctctaccgcgacccgctgccgagggcagacatcatccgcagcctacaggcagaagatgtggcagtggatgggcagaactggacgtttgcttttgacttctccttcctgagccaacaagaggatctggcatgggctgagctccggctgcagctgtccagccctgtggacctccccactgagggctcacttgccattgagattttccaccagccaaagcccgacacagagcaggcttcagacagctgcttagagcggtttcagatggacctattcactgtcactttgtcccaggtcaccttttccttgggcagcatggttttggaggtgaccaggcctctctccaagtggctgaagcaccctggggccctggagaagcagatgtccagggtagctggagagtgctggccgcggccccccacaccgcctgccaccaatgtgctccttatgctctactccaacctctcgcaggagcagaggcagctgggtgggtccaccttgctgtgggaagccgagagctcctggcgggcccaggagggacagctgtcctgggagtggggcaagaggcaccgtcgacatcacttgccagacagaagtcaactgtgtcggaaggtcaagttccaggtggacttcaacctgatcggatggggctcctggatcatctaccccaagcagtacaacgcctatcgctgtgagggcgagtgtcctaatcctgttggggaggagtttcatccgaccaaccatgcatacatccagagtctgctgaaacgttaccagccccaccgagtcccttccacttgttgtgccccagtgaagaccaagccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcacagaggctgctgtcaggaagagggaggaagaagcctgtgcagggggctggctggatgttctctttactgaaaagacagtggcaaggaaaagcacaagtgcatgagttctttactggattttttaaaaacctgtgaaccccccgaaactgtatgtgaaagttgagacatatgtgcatgtattttggaggtgggatgaagtcacctatagctttcatgtattctccaaagtagtctgtgtgtgacctgtccccctccccaaagattaaggatcactgtatagattaaaaagagtccgtcaatctcattgcctcaggctgggttgggggagccccacagctttctggctggccagtggcaatctactggccttgtccagaggctcactggagtggttctctgctaatgagctgtacaacaataaagccattgtctagttctcctgggccagctggtgcctgtgaaggcagaggcaggaactcatccaagaggaccggccatgttgggttacagaagacatccctgcgtcagtctgcttcggcagacacagcctgagtttgttaaagttggtgacaatccacctcagtctctcaatgtgtgctattaatgaggcctctgagcttcctatccagcagtggtgaaggccttgccctgggtggcaagatacttgctctatggtcacagctcagccactggaagctgtgcgacctcaggtgagcaattcactgtccagtctccacttgtaaaaggaacgctggtgaatcctaatgcattcatattaaatgtctgttgtcaggctcagaagagccatgagcttt

SEQ ID NO: 87 - protein, 347 aa, Homo sapiens
MHAHCLPFLLHAWWALLQAGAATVATALLRTRGQPSSPSPLAYMLSLYRDPLPRADIIRSLQAEDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 88 - DNA, 1892 bp, Homo sapiens
aaaccggtgccaacgtgcgcggacgccgccgccgccgccgccgctggagtccgccgggcagagccggccgcggagcccggagcaggcggagggaagtgcccctagaaccagctcagccagcggcgcttgcacagagcggccggacgaagagcagcgagaggaggaggggagagcggctcgtccacgcgccctgcgccgccgccggcccgggaaggcagcgaggagccggcgcctcccgcgccccgcggtcgccctggagtaatttcggatgcccagccgcggccgccttccccagtagacccgggagaggagttgcggccaacttgtgtgcctttcttccgccccggtgggagccggcgctgcgcgaagggctctcccggcggctcatgctgccggccctgcgcctgcccagcctcgggtgagccgcctccggagagacgggggagcgcggcggcgccgcgggctcggcgtgctctcctccggggacgcgggacgaagcagcagccccgggcgcgcgccagaggcatggagcgctgccccagcctaggggtcaccctctacgccctggtggtggtcctggggctgcgggcgacaccggccggcggccagcactatctccacatccgcccggcacccagcgacaacctgcccctggtggacctcatcgaacacccagaccctatctttgaccccaaggaaaaggatctgaacgagacgctgctgcgctcgctgctcgggggccactacgacccaggcttcatggccacctcgccccccgaggaccggcccggcgggggcgggggtgcagctgggggcgcggaggacctggcggagctggaccagctgctgcggcagcggccgtcgggggccatgccgagcgagatcaaagggctagagttctccgagggcttggcccagggcaagaagcagcgcctaagcaagaagctgcggaggaagttacagatgtggctgtggtcgcagacattctgccccgtgctgtacgcgtggaacgacctgggcagccgcttttggccgcgctacgtgaaggtgggcagctgcttcagtaagcgctcgtgctccgtgcccgagggcatggtgtgcaagccgtccaagtccgtgcacctcacggtgctgcggtggcgctgtcagcggcgcgggggccagcgctgcggctggattcccatccagtaccccatcatttccgagtgcaagtgctcgtgctagaactcgggggccccctgcccgcacccggacacttgatcgatccccaccgacgccccctgcaccgcctccaaccagttccaccaccctctagcgagggttttcaatgaacttttttttttttttttttttttttttctgggctacagagacctagctttctggttcctgtaatgcactgtttaactgtgtaggaatgtatatgtgtgtgtatatacggtcccagttttaatttacttattaaaaggtcagtattatacgttaaaagttaccggcttctactgtatttttaaaaaaaagtaagcaaaagaaaaaaaaaagaacagagaaaagagagacttattctggttgttgctaataatgttaacctgctatttatattccagtgcccttcgcatggcgaagcaggggggaaaagttatttttttcttgaagtacaaagagacgggggaacttttgtagaggactttttaaaagctattttccattcttcggaaagtgttttggttttccttggacctcgaagaagctatagagttcaatgttattttacagttattgtaaatatagagaacaaatggaatgactaatcattgtaaattaagagtatctgctatttattctttataatatcccgtgtagtaaatgagaaagaagtgcagagcaggatt

SEQ ID NO: 89 - protein, 232 aa, Homo sapiens
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 90 - DNA, 1591 bp, Homo sapiens
cgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccggacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattccaaaaaaa

SEQ ID NO: 91 - protein, 470 aa, Homo sapiens
MAGENHQWQGSILYNMLMSAKQTRAAPEAPETRLVDQCWGCSCGDEPGVGREGLLGGRNVALLYRCCFCGKDHPRQGSILYSMLTSAKQTYAAPKAPEATLGPCWGCSCGSDPGVGRAGLPGGRPVALLYRCCFCGEDHPRQGSILYSLLTSSKQTHVAPAAPEARPGGAWWDRSYFAQRPGGKEALPGGRATALLYRCCFCGEDHPQQGSTLYCVPTSTNQAQAAPEERPRAPWWDTSSGALRPVALKSPQVVCEAASAGLLKTLRFVKYLPCFQVLPLDQQLVLVRNCWASLLMLELAQDRLQFETVEVSEPSMLQKILTTRRRETGGNEPLPVPTLQHHLAPPAEARKVPSASQVQAIKCFLSKCWSLNISTKEYAYLKGTVLFNPDVPGLQCVKYIQGLQWGTQQILSEHTRMTHQGPHDRFIELNSTLFLLRFINANVIAELFFRPIIGTVSMDDMMLEMLCTKI

SEQ ID NO: 92 - protein, 400 aa, Homo sapiens
MAGENHQWQGSILYNMLMSAKQTRAAPEAPETRLVDQCWGCSCGDEPGVGREGLLGGRNVALLYRCCFCGKDHPRQGSILYSMLTSAKQTYAAPKAPEATLGPCWGCSCGSDPGVGRAGLPGGRPVALLYRCCFCGEDHPRQGSILYSLLTSSKQTHVAPAAPEARPGGAWWDRSYFAQRPGGKEALPGGRATALLYRCCFCGEDHPQQGSTLYCVPTSTNQAQAAPEERPRAPWWDTSSGALRPVALKSPQVVCEAASAGLLKTLRFVKYLPCFQVLPLDQQLVLVRNCWASLLMLELAQDRLQFETVEVSEPSMLQKILTTRRRETGGNEPLPVPTLQHHLAPPAEARKVPSASQVQAIKCFLSKCWSLNISTKEYAYLKGTVLFNPGKGKENDCNHH

SEQ ID NO: 93 - DNA, 4916 bp, Homo sapiens
aaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgtgaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcgcagtctcagtcacccgtgttatcttcgtggctcaaaggacaatgcaaaatcgccgatcagagctcatacccaaagcattacagagaacagcagcatcattgccctccccagctgaaaaacaagttggctagaagatacatggagaggaatggtgtggtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccatagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaaaaaaaaaa

SEQ ID NO: 94 - protein, 495 aa, Homo sapiens
MSSNSDTGDLQESLKHGLTPIVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 95 - DNA, 1626 bp, Homo sapiens
atgtcttctaattcagatactggggatttacaagagtctttaaagcacggacttacacctattggtgctgggcttccggaccgacacggatcccccatccccgcccgcggtcgccttgtcatgctgcccaaagtggagacggaagccctgggactggctcgatcgcatggggaacagggccagatgccggaaaacatgcaagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataa

SEQ ID NO: 96 - DNA, 1488 bp, Homo sapiens
atgtcttctaattcagatactggggatttacaagagtctttaaagcacggacttacacctattgtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataa

SEQ ID NO: 97 - protein, 541 aa, Homo sapiens
MSSNSDTGDLQESLKHGLTPIGAGLPDRHGSPIPARGRLVMLPKVETEALGLARSHGEQGQMPENMQVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 98 - DNA, 1488 bp, Homo sapiens; identical to SEQ ID NO: 96

SEQ ID NO: 99 - DNA, 1918 bp, Homo sapiens
gcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactatttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgaaaaaaaaaaaaaaaa

SEQ ID NO: 100 - protein, 478 aa, Homo sapiens
MERDEPPPSGGGGGGGSAGFLEPPAALPPPPRNGFCQDELAELDPGTISVSDDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVG

SEQ ID NO: 101 - DNA, 1428 bp, Homo sapiens
atggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatga

SEQ ID NO: 102 - protein, 476 aa, Homo sapiens
MERDEPPPSGGGGGGGSAGFLEPPAALPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 103 - DNA, 5206 bp, Homo sapiens
cccgccgcggaggccgagcgagcccccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaggtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctcaaaaaaaaaaaaaaaaaaaaaaaaaaaaaaaa

SEQ ID NO: 104 - protein, 1004 aa, Homo sapiens
METESEQNSNSTNGSSSSGGSSRPQIAQMSLYERQAVQALQALQRQPNAAQYFHQFMLQQQLSNAQLHSLAAVQQATIAASRQASSPNTSTTQQQTTTTQASINLATTSAAQLISRSQSVSSPSATTLTQSVLLGNTTSPPLNQSQAQMYLRPQLGNLLQVNRTLGRNVPLASQLILMPNGAVAAVQQEVPSAQSPGVHADADQVQNLAVRNQQASAQGPQMQGSTQKAIPPGASPVSSLSQASSQALAVAQASSGATNQSLNLSQAGGGSGNSIPGSMGPGGGGQAHGGLGQLPSSGMGGGSCPRKGTGVVQPLPAAQTVTVSQGSQTEAESAAAKKAEADGSGQQNVGMNLTRTATPAPSQTLISSATYTQIQPHSLIQQQQQIHLQQKQVVIQQQIAIHHQQQFQHRQSQLLHTATHLQLAQQQQQQQQQQQQQQQPQATTLTAPQPPQVPPTQQVPPSQSQQQAQTLVVQPMLQSSPLSLPPDAAPKPPIPIQSKPPVAPIKPPQLGAAKMSAAQQPPPHIPVQVVGTRQPGTAQAQALGLAQLAAAVPTSRGMPGTVQSGQAHLASSPPSSQAPGALQECPPTLAPGMTLAPVQGTAHVVKGGATTSSPVVAQVPAAFYMQSVHLPGKPQTLAVKRKADSEEERDDVSTLGSMLPAKASPVAESPKVMDEKSSLGEKAESVANVNANTPSSELVALTPAPSVPPPTLAMVSRQMGDSKPPQAIVKPQILTHIIEGFVIQEGAEPFPVGCSQLLKESEKPLQTGLPTGLTENQSGGPLGVDSPSAELDKKANLLKCEYCGKYAPAEQFRGSKRFCSMTCAKRYNVSCSHQFRLKRKKMKEFQEANYARVRRRGPRRSSSDIARAKIQGKCHRGQEDSSRGSDNSSYDEALSPTSPGPLSVRAGHGERDLGNPNTAPPTPELHGINPVFLSSNPSRWSVEEVYEFIASLQGCQEIAEEFRSQEIDGQALLLLKEEHLMSAMNIKLGPALKICAKINVLKET

SEQ ID NO: 105 - DNA, 2122 bp, Homo sapiens
tgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaaaaaaaaaaaaaaaaaaaaa

SEQ ID NO: 106 - protein, 271 aa, Homo sapiens
METNCRKLVSACVQLEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 107 - DNA, 816 bp, Homo sapiens
atggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtga

SEQ ID NO: 108 - DNA, 954 bp, Homo sapiens
atggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtga

SEQ ID NO: 109 - protein, 317 aa, Homo sapiens
METNCRKLVSACVQLGVQPAAVECLFSKDSEIKKVEFTDSPESRKEAASSKFFPRQHPGANEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 110 - DNA, 954 bp, Homo sapiens; identical to SEQ ID NO: 108

SEQ ID NO: 111 - DNA, 975 bp, Homo sapiens
atgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtga

SEQ ID NO: 112 - protein, 324 aa, Homo sapiens
MNCMKGPLHLEHRAAGTKLSAVSSSSCHHPQPLAMASVLAPGQPRSLDSSKHRLEVHTISDTSSPEAAEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 113 - DNA, 6007 bp, Homo sapiens
agccgcgcagacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctactagagacagtgtttcaccatgtcagccaggctggtcttgaactcctgacctcgggtgatctgcccaccttggcctcccaaagtgctgggattacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaaaaaaaaaaaaaaaaaaaaaaaaa

SEQ ID NO: 114 - protein, 558 aa, Homo sapiens
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 115 - DNA, 1581 bp, Homo sapiens
atgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctag

SEQ ID NO: 116 - protein, 526 aa, Homo sapiens
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 117 - DNA, 1411 bp, Homo sapiens
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 118 - protein, 360 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 119 - DNA, 1743 bp, Homo sapiens
ctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagaggcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 120 - DNA, 1257 bp, Homo sapiens
ctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 121 - protein, 265 aa, Homo sapiens
MHFYRLFLGATRRFLNPEWKGEIDNWCVYVLTSLLPFKIQSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 122 - DNA, 5572 bp, Homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcaaaaaaaaaaaaaaaaaaaaaaaaaaa

SEQ ID NO: 123 - protein, 403 aa, Homo sapiens [sequence omitted]

SEQ ID NO: 124 - DNA, 7333 bp, Homo sapiens
ggcggcggcggcggcgcggactgggtgcgcggcgcagcgtcctgtgttggaatgtgcggctgccgcgagctcgcggcgcagcagcggagcgagcgccgccgaggcccggggccccagaccctggcggcggctgccgcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttcagttcttagtttgtaaggtatattacattttatattcatttatgatagcagacaaccttttaagattgctttaattagtatctgatgttgatttttaagtggcattcttttccttaggactttttatgtatacctgttgattgttgtgtaaattttagtaaatctaagagagtgtactaaaccagcaggtatctgttagcttatgtgtttaattgaaattagaaggctaagatggtataacagcattttattgctttgtccagctacaacttgtcatttttttctccatgtcttatcttcctgtttcactttagtttattcttcgttttttattgagatctataaaaaattggcttacttaatagcaaattacttgaagaatttgcctgctttatataaagttagcactttaagatttttttttttagagatgagaagacatttaaattgaagaaaaattcccccagcaatagacagtctatcagtccaagtatttacttcctgagttttgatcaatattttttatttgtgtatgttaatcgtcataaaaacagtgattttggtgtgttttttattttggtgctttaatggcttaagatgttgcacattttttttttcttttggtttctgtttatgtttttttgcctatgcagttaaatttttcctagaaatagcatttgtgttgaacagtaacactttatacatatatatatgcatgtttattttgtttggcgtctttggagggatgcttttagacttgtttgcaaaagggcagttttctttttctttgctgcagttgtctattttgcagaataatagtgtgtgcaagtttgtgagcaaatgaaatatgcaggttcaatctattgattttgatttttacatcttatatctatgccagaatctgtatttcatataacttatttatttcgaatggatgtagtaaattcacagctatcagttttgattttgcaataaataaaccactaggttgcatgtcgaacaaatttttatctcaaataccaaccatcagttttttttttcatgtgttttggtacagctaattcctaattgtagagtgttaaatgtttgaggagaaccttttctcatagatggttggtgttcatatggctactttacaataaagagaactgtaagtgatatttggaaactacaaacctggaattaggagatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcatttttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagttttaaaaacca

SEQ ID NO: 125 - DNA, 3294 bp, Homo sapiens
atggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaa

SEQ ID NO: 126 - protein, 1097 aa, Homo sapiens
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 127 - protein, 313 aa, Homo sapiens
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGKRSFLVHKFSSLF

SEQ ID NO: 128 - protein, 329 aa, Homo sapiens
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGW

SEQ ID NO: 129 - protein, 1074 aa, Homo sapiens
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 130 - DNA, 4581 bp, Homo sapiens
ggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggctccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggattttaga

SEQ ID NO: 131 - protein, 1221 aa, Homo sapiens
MLRSTGFFRAIDCPYWSGAPGGPCRRPYCHFRHRGARGSGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 132 - DNA, 3487 bp, Homo sapiens
atgcgcgttccggccgaaggggggtaaatttcccaactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcaccggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaaaatgcataccaaaaa

SEQ ID NO: 133 - protein, 1053 aa, Homo sapiens
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCKYCSKVFGTDSSLQIHLRSHTGERPFVCSVCGHRFTTKGNLKVHFHRHPQVKANPQLFAEFQDKVAAGNGIPYALSVPDPIDEPSLSLDSKPVLVTTSVGLPQNLSSGTNPKDLTGGSLPGDLQPGPSPESEGGPTLPGVGPNYNSPRAGGFQGSGTPEPGSETLKLQQLVENIDKATTDPNECLICHRVLSCQSSLKMHYRTHTGERPFQCKICGRAFSTKGNLKTHLGVHRTNTSIKTQHSCPICQKKFTNAVMLQQHIRMHMGGQIPNTPLPENPCDFTGSEPMTVGENGSTGAICHDDVIESIDVEEVSSQEAPSSSSKVPTPLPSIHSASPTLGFAMMASLDAPGKVGPAPFNLQRQGSRENGSVESDGLTNDSSSLMGDQEYQSRSPDILETTSFQALSPANSQAESIKSKSPDAGSKAESSENSRTEMEGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 134 - DNA, 5672 bp, Homo sapiens
aagcaccactgcagcagaccttgttaattttttttttttttctttccacacaacagttgtgcctcattatccggtgcctggctcggaatttttttttttttttttctttttggagggtttgaagtttctgtgcttcagtgactgttacagaagaagaggtgttagtgttgccatgaggtcttgattgtctgcatttatgaatgaaactgacctaaatcacctgttacctccagtttccagattgtttgaacttctctggccgcacaatacaggaaggaagactaaagcagcaaagggacctacagcgtctgcagcatgggctggttaactaggattgtctgtcttttctggggagtattacttacagcaagagcaaactatcagaatgggaagaacaatgtgccaaggctgaaattatcctacaaagaaatgttggaatccaacaatgtgatcactttcaatggcttggccaacagctccagttatcataccttccttttggatgaggaacggagtaggctgtatgttggagcaaaggatcacatattttcattcgacctggttaatatcaaggattttcaaaagattgtgtggccagtatcttacaccagaagagatgaatgcaagtgggctggaaaagacatcctgaaagaatgtgctaatttcatcaaggtacttaaggcatataatcagactcacttgtacgcctgtggaacgggggcttttcatccaatttgcacctacattgaaattggacatcatcctgaggacaatatttttaagctggagaactcacattttgaaaacggccgtgggaagagtccatatgaccctaagctgctgacagcatcccttttaatagatggagaattatactctggaactgcagctgattttatggggcgagactttgctatcttccgaactcttgggcaccaccacccaatcaggacagagcagcatgattccaggtggctcaatgatccaaagttcattagtgcccacctcatctcagagagtgacaatcctgaagatgacaaagtatactttttcttccgtgaaaatgcaatagatggagaacactctggaaaagctactcacgctagaataggtcagatatgcaagaatgactttggagggcacagaagtctggtgaataaatggacaacattcctcaaagctcgtctgatttgctcagtgccaggtccaaatggcattgacactcattttgatgaactgcaggatgtattcctaatgaactttaaagatcctaaaaatccagttgtatatggagtgtttacgacttccagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaacttgtcccagcaaaacatttggtggttttgactctacaaaggaccttcctgatgatgttataacctttgcaagaagtcatccagccatgtacaatccagtgtttcctatgaacaatcgcccaatagtgatcaaaacggatgtaaattatcaatttacacaaattgtcgtagaccgagtggatgcagaagatggacagtatgatgttatgtttatcggaacagatgttgggaccgttcttaaagtagtttcaattcctaaggagacttggtatgatttagaagaggttctgctggaagaaatgacagtttttcgggaaccgactgctatttcagcaatggagctttccactaagcagcaacaactatatattggttcaacggctggggttgcccagctccctttacaccggtgtgatatttacgggaaagcgtgtgctgagtgttgcctcgcccgagacccttactgtgcttgggatggttctgcatgttctcgctattttcccactgcaaagagacgcacaagacgacaagatataagaaatggagacccactgactcactgttcagacttacaccatgataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacaatggatgagttctgtgaacaagtttggaaaagggaccgaaaacaacgtcggcaaaggccaggacataccccagggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaatatacatgaacttttttcatggcattatgtggatgtttacaatggtgggaaattcagctgagttccaccaattataaattaaatccatgagtaactttcctaataggctttttttcctaataccaccacctaacagagaacacaggtgaatgcagatgttcactttagcagacttaatgtttcctatgagatttcactgtacaggtttgtctttcttctttgcctgagaaataaaaatgtcatttgccatattgccatctaaaggagaaaaactgcatcagcaaagccattgtattgaactaaaagtttaaaatgaactgcatggatttactaagctgatgaatattccaaaacgtggttggattcaaggatatattttgtctaccggccctcatgtttgtatgtacttgaggagtaaaatgagtaaaatgatactgaatgaaatgttctgtggaaatattaaaaaaaaaaaaaaacataagccatccatcatccagaagaaaaatggaatacactgatctactactgatgtcttctttcagctttgatctaaagatgtattttattaaaactataatttaaatgtaccatgaaaaatatgcagtaaaaattagttgttttctaagctagagtaggatttgtcttacaattattgtgctatgtagtttttgttttaaaaattccaatggtgtgctgctttctttggacattttattttcaattctataagagggatagatgacattgttctagaaacacatatacatcattaagagtgaatctctaaaaccaggatataaattatgctttatttctctgagaaaatcaaacaaatggaagctgttcacacctccccttctttaagcattatctaaattaatttttacttgcataatgttcttagaaaaaaaaacagaacatttaagcaggaaaaaaggaagaaacaagttgatttttaagtgcattttactataatgaatcaatgaagggaaaaggaactgcatatttcatgaaaataataagcattgtcttaatatactgttaatagaaaatgtgtcttaattccgtgcttgaatccctgcatgatatttgagactaagatctctcttatgattctaccaagaattatatctgtgtcacttaatttttttaaaagagagagatcaataactattcagagcaacatgttaaaggcaaagtttccaatcatttacatctgtatcaggtgcctcttacctttccttatttaagacaattatttgtacaagaaacacatgactcttttcatatcaatgggagggacttttctacaaagtattttccaggatgcaacccacatttaaacaatgtaaaattctttgtttcctgcaacaacttacaaaataaggtaaaagactaaaattcaagatttgcttccttcattgtcctaagacgattcgttgagaatcactgactttgagatatttaaaactttcagcattatactgtggtttcttttgcactgcactcacctattcaggactcctcccccaggttcctcatcatgcacaaaaatgcaaagaaaacatcttattagtaattaatgaagcaacattgaaattctaactctagctgtctttggattctaattaactcagcatcaatttctcacctcagactacagtgaatttttatttcctatcagctgaaatatttcacagatggaagctcatgtttcagttttaatgactgccttgaataaacaagttgttgccacttgtttcaaacaaaagcctaaaaataatctacattcaattttaggctccattgactaatatggtgttgcttttggaagtactgtatatcctcacatggaagccaaattgttaaattatttgaaggacacaccactgtacagaaagtagtgtttcaaatataaatcgaagaacaaagagtgctccaaaaaataggtcattcttttattttcataaagtatctaaactgtactaacattcagtgttgtgtttcattctaaatttgcagctgaaataaatttatttgcgatagcagaaatatcttattattcatcctcagaaataaaggatttgaagggatagagattatatgataaatttatagaagactttcagaatttgaatgcattttgtttagtgttatgaaatgacaatagaaaaaagtctcgacttcaattaaaagttacacaaacaaacaaatctacaggcatgtctttatataccatcaggtctaagttttcaaagaaaattgtagatataacttgcagataactcattacagtcataatctctgcccatgtgtattgagagggggcagtttgcacgaaaaagaattattggcccatttaataattcagctttaaatagactttgtcatatgcatgaatcatcagagatgaaactgtttgagagactcatgtgaccttacgaaaattacaacagcagtcttaaagtatgaaaaagatgcatcacagcagagacattatggcccagttgatatcaaatgtaaaatgtaaatgcatgtaaatgcacacttcattttatgtattatttagtaatttgcagtggtatgtgtttaatatttttgctacctacacattaggcaaaaaaaagatgtaaataatttgggagaaaaagaggaagaacagtgtaaaataaaactttctataagtactccatttcaatgtgttcaacatcatcctaaaaggcaagattttcccacgcaggtgacaaggtggtttatgtactatttaagggcggaaggtgcgtgcccgttcaataagcatgttttttgccaggtaggaaatatgttccatatctttacttatcattgcatttcagatgggaactagaaaaactggagagaaaaatgtaatgaaactgctgctgtaaattattccttttagcatgtattcacttgctaaatacacatttcttcaaaataaaaaaaaaaaaaa

SEQ ID NO: 135 - protein, 771 aa, Homo sapiens [sequence omitted]

SEQ ID NO: 136 - DNA, 2005 bp, Homo sapiens
caacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatccctgccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctataaaaaaaaaaaaaaa

SEQ ID NO: 137 - protein, 295 aa, Homo sapiens
MLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 138 - DNA, 2518 bp, Homo sapiens
ctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaaaaaaaaaa

SEQ ID NO: 139 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 140 - DNA, 954 bp, Homo sapiens
atgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtga

SEQ ID NO: 141 - DNA, 2174 bp, Homo sapiens
aatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaaaaaa

SEQ ID NO: 142 - protein, 188 aa, Homo sapiens
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 143 - DNA, 519 bp, Homo sapiens
atggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaa

SEQ ID NO: 144 - DNA, 4018 bp, Homo sapiens
caggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 145 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 146 - DNA, 3210 bp, Homo sapiens
atgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactga

SEQ ID NO: 147 - protein, 807 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVLRPVPGDPAGLHPLHAALQPVLRRHGEQAVCGDSAGRAAPAFGG

SEQ ID NO: 148 - DNA, 829 bp, Homo sapiens
ccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagag

SEQ ID NO: 149 - protein, 172 aa, Homo sapiens
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 150 - DNA, 1157 bp, Homo sapiens
cgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacatcctgggcccgctgcgcgaccagctgctgaccttgaaccagcacgtggagcagctgcgcggcgccttcgaccagacagtgtccctggccgtgggcttcattctgggcagcgcggccgccgagcgaggggtcctcagggacccgtgccagtgagtcccggctgcggccagtctcccctctccaggccgaggcccctccgccctgacccctcctgctgccttcccacccccgttcttgggtatgttcaataaaaggattgttttcctaga

SEQ ID NO: 151 - protein, 341 aa, Homo sapiens
MLLRPRRPPPLAPPAPPSPASPDPEPRTPGDAPGTPPRRPASPSALGELGLPVSPGSAQRTPWSARETELLLGTLLQPAVWRALLLDRRQALPTYRRVSAALAQQQVRRTPAQCRRRYKFLKDKFREAHGQPPGPFDEQIRKLMGLLGDNGRKRPRRRSPGSGRPQRARRPVPNAHAPAPSEPDATPLPTARDRDADPTWTLRFSPSPPKSADASPAPGSPPAPAPTALATCIPEDRAPVRGPGSPPPPPAREDPDSPPGRPEDCAPPPAAPPSLNTALLQTLGHLGDIANILGPLRDQLLTLNQHVEQLRGAFDQTVSLAVGFILGSAAAERGVLRDPCQ

SEQ ID NO: 152 - DNA, 2646 bp, Homo sapiens
agtttctcctttgttttacgtttgggaggaggtggcattggaaatagcagagtgcttcgcggtaacaggggttggagtgcaatggtgtgatctcagctcactgcaacccctgcctcccaggctccagcgatcctcccacctcagcctcctgaatagctgaccaccagcacactaggcaaacccaccccactcaccgcctcccttgggaattcagacctaaccatcgctgagctgaaacaaatgtactgaggctggagcctgtgtgaacagaacagaagaggccttcactctagtagtgctcacagtccagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaaattgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttc

SEQ ID NO: 153 - protein, 310 aa, Homo sapiens
MSQQLKKRAKTRHQKGLGGRAPSGAKPRQGKSSQDLQAEIEPVSAVWALCDGYVCYEPGPQALGGDDFSDCYIECVIRGEFSQPILEEDSLFESLEYLKKGSEQQLSQKVFEASSLECSLEYMKKGVKKELPQKIVGENSLEYSEYMTGKKLPPGGIPGIDLSDPKQLAEFARKKPPINKEYDSLSAIACPQSGCTRKLRNRAALRKHLLIHGPRDHVCAECGKAFVESSKLKRHFLVHTGEKPFRCTFEGCGKRFSLDFNLRTHVRIHTGEKRFVCPFQGCNRRFIQSNNLKAHILTHANTNKNEQEGK

SEQ ID NO: 154 - DNA, 2490 bp, Homo sapiens
agcactctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcagggtgatcgcacaacctgcatctttagtgctttcttgtcagtggcgttgggagggggagaaaaggaaaagaaaaaaaaaagaagaagaagaagaaaagagaagaagaaaaaaacgaaaacagtcaaccaaccccatcgccaactaagcgaggcatgcctgagagacatggctttcagaaaacgggaagcgctcagaacagtatctttgcactccaatcattcacggagatatgaagagcaactgggacctgagtcaatgcgcaaaatgcagcttgtgtgcaaaagcagtgggctcctggcagaagggagcagcacacgcgttatagtaactcccatcacctctaacacgcacagctgaaagttcttgctcgggtcccttcacctcctcgccctttcttaaagtgcagttcttagccctctagaaacgagttggtgtctttcgtctcagtagcccccaccccaataagctgtagacattggtttacagtgaaactatgctattctcagccctttgaaactctgcttctcctccagggcccgattcccaaaccccatggcttccctcacactgtcttttctaccattttcattatagaatgcttccaatcttttgtgaattttttattataaaaaatctatttgtatctatcctaaccagttcggggatatattaagatatttttgtacataagagagaaagagagagaaaaatttatagaagttttgtacaaatggtttaaaatgtgtatatcttgatactttaacatgtaatgctattacctctgcatattttagatgtgtagttcaccttacaactgcaattttccctatgtggttttgtaaagaactctcctcataggtgagatcaagaggccaccagttgtacttcagcaccaatgtgtcttactttatagaaatgttgttaatgtattaatgatgttattaaatactgttcaagaagaacaaagtttatgcagctactgtccaaactcaaagtggcagccagttggttttgataggttgccttttggagatttctattactgcctttttttttcttactgttttattacaaacttacaaaaatatgtataaccctgttttatacaaactagtttcgtaataaaactttttcctttttttaaaatgaaaataaaaaaaa

SEQ ID NO: 155 - protein, 236 aa, Homo sapiens
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 156 - DNA, 1772 bp, Homo sapiens
aggacagccgagttcaggtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccgcaagcctacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccatctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacttctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttctcttttcaaaaatgtataaaaatcattatacatagcattaaagaaacatttttgagaagtacaaatca

SEQ ID NO: 157 - protein, 265 aa, Homo sapiens
MYVGYVLDKDSPVYPGPARPASLGLGPQAYGPPAPPPAPPQYPDFSSYSHVEPAPAPPTAWGAPFPAPKDDWAAAYGPGPAAPAASPASLAFGPPPDFSPVPAPPGPGPGLLAQPLGGPGTPSSPGAQRPTPYEWMRRSVAAGGGGGSGKTRTKDKYRVVYTDHQRLELEKEFHYSRYITIRRKSELAANLGLTERQVKIWFQNRRAKERKVNKKKQQQQQPPQPPMAHDITATPAGPSLGGLCPSNTSLLATSSPMPVKEEFLP

SEQ ID NO: 158 - protein, 130 aa, Homo sapiens
MRRSVAAGGGGGSGKTRTKDKYRVVYTDHQRLELEKEFHYSRYITIRRKSELAANLGLTERQVKIWFQNRRAKERKVNKKKQQQQQPPQPPMAHDITATPAGPSLGGLCPSNTSLLATSSPMPVKEEFLP

SEQ ID NO: 159 - DNA, 2613 bp, Homo sapiens
agcatttgattgtggcttgggacgcgaggagaggcgcgcagcgaccgcctgacggcaggcaatggtgtaagcgcctctcggcctccccctccccccagacgcggccgggtcctcccttcgccttctggacacacacccctgcctcgtctcttccgcctctctcgcactccggtccgttcctgtcctctgcggaggccagccctggggaggtgcagcgcccgccaggatgagtggctccttcgatcgcaagctcagcagcatcctcaccgacatctccagctcccttagctgccatgcgggctccaaggactcgcctaccctgcccgagtcttctgtcactgacctgggctactacagcgctccccagcacgattactactcgggccagccctatggccagacggtgaacccctacacctaccaccaccaattcaatctcaatgggcttgcaggcacgggcgcttactcgcccaagtcggaatatacctacggagcctcctaccggcaatacggggcgtatcgggagcagccgctgccagcccaggacccagtgtcggtgaaggaggagccggaagcagaggtgcgcatggtgaatgggaagcccaagaaggtccgaaagccgcgtacgatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacatttgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacataccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcctagccttctcatttctgctttcttactggactcatctttatatataatgttaataaaaaagacgaaaataaaaaaaaaaaaa

SEQ ID NO: 160 - protein, 287 aa, Homo sapiens
MSGSFDRKLSSILTDISSSLSCHAGSKDSPTLPESSVTDLGYYSAPQHDYYSGQPYGQTVNPYTYHHQFNLNGLAGTGAYSPKSEYTYGASYRQYGAYREQPLPAQDPVSVKEEPEAEVRMVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 161 - DNA, 1424 bp, Homo sapiens
agcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaagcggaa

SEQ ID NO: 162 - protein, 289 aa, Homo sapiens
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 163 - protein, 191 aa, Homo sapiens
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVNTALPCTRPA

SEQ ID NO: 164 - DNA, 2950 bp, Homo sapiens
gcgccgagcgccgccgccgccgccgccgccgccgctccgctgcccgcgccgcccgcggctcccgatggagactgacgcgccccagcccggcctcgcctccccggactcgccgcacgacccctgcaagatgttcatcgggggactcagttggcagactacgcaggaagggctgcgcgaatacttcggccagttcggggaggtgaaggagtgtctggtgatgcgggaccccctgaccaagagatccaggggtttcggcttcgtcactttcatggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgaattccgtgtagagcggacccctctcccgagcgccccagtcctccccgagcttacagccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttgggggccctttgattgccacagccttcaccaatgggtaccactgaagcaggggacggtggcaggagcgccccagcctgcagctgactgaggaccacgagtgagccagcgagggggcgggagacctcagccgcagccgccgccccctcccctgcagcgactcggacccgctactgcctgcccccaactccccgggcccggcccctgccctgctgcccccaacagcgtctggctcccctactaacgtccccctcttcgcccttgcccccatccccacccgcccctctcccggccctgcttttatttattttggattagccggttgcccaccccagccctctggtccatccctccctccgtgccgcgcccccctaggaccgccccctccccaaaaggcttttggatttgtgcatagctggagtgaaggcggagggagcctgctacaggccgcagcccaacccctgttttttattcagatttcccctcctttaccctttccctttttttttttttttttttttttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctcagtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcctaataaattatttgaaaacgtt

SEQ ID NO: 165 - protein, 362 aa, Homo sapiens
METDAPQPGLASPDSPHDPCKMFIGGLSWQTTQEGLREYFGQFGEVKECLVMRDPLTKRSRGFGFVTFMDQAGVDKVLAQSRHELDSKTIDPKVAFPRRAQPKMVTRTKKIFVGGLSVNTTVEDVKQYFEQFGKVDDAMLMFDKTTNRHRGFGFVTFESEDIVEKVCEIHFHEINNKMVECKKAQPKEVMSPTGSARGRSRVMPYGMDAFMLGIGMLGYPGFQATTYASRSYTGLAPGYTYQFPEFRVERTPLPSAPVLPELTAIPLTAYGPMAAAAAAAAVVRGTGSHPWTMAPPPGSTPSRTGGFLGTTSPGPMAELYGAANQDSGVSSYISAASPAPSTGFGHSLGGPLIATAFTNGYH

SEQ ID NO: 166 - DNA, 1089 bp, Homo sapiens
atggagactgacgcgccccagcccggcctcgcctccccggactcgccgcacgacccctgcaagatgttcatcgggggactcagttggcagactacgcaggaagggctgcgcgaatacttcggccagttcggggaggtgaaggagtgtctggtgatgcgggaccccctgaccaagagatccaggggtttcggcttcgtcactttcatggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgaattccgtgtagagcggacccctctcccgagcgccccagtcctccccgagcttacagccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttgggggccctttgattgccacagccttcaccaatgggtaccactga

SEQ ID NO: 167 - DNA, 4108 bp, Homo sapiens
ccggccgtctatgctccaggccctctcctcgcggtgccggtgaacccgccagccgccccgatgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcggccgtgggccagcgcctggagagcccaggcggcgcggcgggcggcggctacgcgcacgtcaacggctgggccaacggcgcctaccccggctcggtggcggcggcggcggcggccgcggccatgatgcaggaggcgcagctggcctacgggcagcacccgggcgcgggcggcgcgcacccgcacgcgcaccccgcgcacccgcacccgcaccacccgcacgcgcacccgcacaacccgcagcccatgcaccgctacgacatgggcgcgctgcagtacagccccatctccaactcgcagggctacatgagcgcgtcgccctcgggctacggcggcctcccctacggcgccgcggccgccgccgccgccgctgcgggcggcgcgcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctagcgccttcgggacgccggggactctgcggcggcgacccacgagctcgcggcccgcgcccggctcccgccccgccccggcgcggcgtggcttttgtacagacgttcccacattcttgtcaaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctgggttttgtaaaactttatgtatctgagcatttccatttttttttttgggttttgtattatttcttgtaaatgcattgtgaaaaattttattttcggcgttgcaatgcggggaggagaagtcagattatgtacatagttttctaaaaagcctttcttctaaaaacgaaaaaagaccccccacccaaaatgtttcgagtcaacaaatttaagagacagagcccattttctccataaatttgtaacatgctatttttatgtgcatgttttatgagttcaaaatgcaatgaggaaatctgacagggaaattatctgtatgaactaaaagtaagggaaccccggggaatgggaggacaggatttttcaaggaacctttttcaatgaaagagaaggaagttaaaacctataggttattttgtagagctgagtgttaatacgggccgagaaataaaagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggatgcaagttgctaaccgatgtgaacgcaaaatgccttgttcattattcctgacgagatcttgaggttgtttgatgctttaaattttttaattatattattttctaggtgtttattggtacattgcagttttttttttgaaatttaaaaatttctgtaaaactttgtcttcaagtaatctgacagcattaaatattgcatttaaaaattatactgtagcaaatacatttaaaaattaatcacaacgttaagatgaaattatatttttggaaaaaaaaaacacttgaagcccagatggaaatacgtttatttcagcagccttaggtttcccctcgctttctcaacacccttccttgtcctggagtatggactgtccgtccaaaagtgagcctatgctataagtttaatgagaaccgaattcagcctgcattcgagaatagctttaagtataatgctgatctgacaattgacgtgtaatttgggaagtcattttgataattttgcttaaaccactcattcgttaaagtgattacaaaaaagttcaagaatgatgtccactgctttctaacaagataataaaccccccccctcttttctttttctttatttttatttcttttagctatttgatcctttctgaagcagttgtttctggaagagtctgtgcgcccatggatggctgagcaccactacgacttagtccgggataagggcctccccagtcctctccgggagatgatttgggaaattttataatgcttgttctgttaactcaccgggaccttgagggtccaatgggaccttgagggttttctctgaaatatacaaacttaaaggactctctctgaggttctttgactgacgtccactctcagtctggcccctgtgctcccctgtgtgtaccctggagtttctgtgtccaattgttggcatctaggtcttggctcaagattaggatgtgggccccactttagaggcacagactatgaaaagctgagttagtgcgcccgggacgccaggcaagcagcttttacagtttggcatcttattgcaggtgcttcgtgcacagtcagctgaaatagccaatgccaggtgctccaaccaccttatttccttgttttgttgattagaacaacacagaaaaaagcaaatataaatttttaatgactccatttaaaaatatcacagggtgggggcaaggaaattagctgagattcatctcaggattgagattctatccccccttccccgcccccagcagtgtcgctccaattcaaattagtggagaaaagattacagtaggccctgagccgactgtgaattcggtgcttggccaaggtaacactcatcgtattcacggagtgaaatactatatgatgatagttattatattatatgacgacttcattcacttcccaaatcacagggt

SEQ ID NO: 168 - protein, 391 aa, Homo sapiens
MYSMMMETDLHSPGGAQAPTNLSGPAGAGGGGGGGGGGGGGGGAKANQDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLAAGAGGGGAAVAMGVGVGVGAAAVGQRLESPGGAAGGGYAHVNGWANGAYPGSVAAAAAAAAMMQEAQLAYGQHPGAGGAHPHAHPAHPHPHHPHAHPHNPQPMHRYDMGALQYSPISNSQGYMSASPSGYGGLPYGAAAAAAAAAGGAHQNSAVAAAAAAAAASSGALGALGSLVKSEPSGSPPAPAHSRAPCPGDLREMISMYLPAGEGGDPAAAAAAAAQSRLHSLPQHYQGAGAGVNGTVPLTHI

SEQ ID NO: 169 - DNA, 3642 bp, Homo sapiens
atcattgtattgcacacctctaaaaaaaacactgcctctgatttatcaatataaaaaagatcctctgagaggaggagggcacttttgtgtgatggcaacttcacttctaggggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcagcgccgcagccgccgccgccgccgccgcagccgccgcctccagctcgcccttcgccaacgactactctgttttccaggcccccggagtttccgggggcagcggcggcggcggcgggggcggcggcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgcccaccctgcgcccgcccctctccccgacctcctcccaccaagtcctcttgggccctgtctgtccggacttcaactccagcctttccctattgcatccgactcgctctctgtctctttctgtttctgcccctcttccttcttccttctgtgacttaactttgtaaaggggatatggacaagtaagtaacacgcatcgctgtcccgggccctggctttccctttccacgggtaacgctgcctgaacccgttgcagccggaacccgcgcctcgtcgggcctttatttctcgttctctcttccttgtcctcccctcctccaccccccaggttgtgaagggcgtaacttttagagggaacggccactggaggtagagctggactaatccagtgcctggtagacagcgggcctcgcgcgggcaggagcggctcggctgacaagcctgagcggagcggtggagagggagaggctggaggcctgggcagaacagcgccgcccgggcagacggctgcttggttccagagccgctgtactgagcacctcggcttcggagcaccctgccaggcccctgggcatcgccggacgtcctactcaggctgtcggggcttggtgggggtgacttttggcagcccgagacccagagtttgtagagtttagatctcccaatgtcagtctgcctctttttctttgttccctgaggtggaaccgatgcaagtttcagcaaagggcagtcttgtcgaatcgctgcagcagctttctttcatctttatagcatatattttatttttaaaaaaactagggggaaaatagcaaccttccatttggtttcccttctataatagttttttcctctaacggggagcaatctttctctcgaaactgctaatattgatcccaaagttactttgactgcattaacttaacttacggggtgggggcgggggtgagggtaggtgcttttttcttatgcaaaaatactcctttccggtgagaccagattaactatctccatgtttgtccttttctacctcgttttttcaccactcccaaacataacctcccaatcttttttgttagtccggccgtcaattgtatagtaccaatttcgtaaattctctcaattcatgaagatcgtagggttaaacttttttgtgtgtgatttaaacttacaaacaagtgaagaagctatcgtttatttcagacgaggctgtagtttaaataccaaaagagggaaaataaaaaagaacctttgtaaaatatatctgaacctaatggtttgtacaactggagaatcgttctagattagttaccaattaaatataactccgccagtgtaagggtgtgaggtgcagttgtccaggagacgattttgtatagtatttttcttgtacattacttccagtaaatatttgaaaatatattgaagtaaacttgattttttttttttgtcacaagaaaatattaagagttattgttgcagttctgatgagctgcaggttttttgaactcacttctggaggtgcagagccacaaacgcactttcggggcctagttttgctcgaatatgaatttagataggtatcaagctgtaactaagacaatattgataaatgttggatgacatttaatttaatggagcatgtacttatttgcatttgctggcagttcaggcatagttaaagtgagagttctcctatatttcataataagtggtctgccaaaacccatgtattaaataaattgtccaagtgaaactcgactaactttggcctttgtgtatttcctgaaggtaatattgttaactgttaataaatacttctgacactacatttaaatgtttgcagattctgcaaactaattgctcattgtaatgttgaaataatttggatatttcacattgaaatgaaaagcctttctctggagcattttagatttgcattttaaatgcatgaaatgtaattgatttatttgtaatattttaaatggtataataaactcagataaaagactaggccaaaaaaaaaa

SEQ ID NO: 170 - protein, 448 aa, Homo sapiens
MLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 171 - DNA, 3738 bp, Homo sapiens
atcattgtattgcacacctctaaaaaaaacactgcctctgatttatcaatataaaaaagatcctctgagaggaggagggcacttttgtgtgatggcaacttcacttctagggcgtggtgcttgctcccgaatcagacgccggcagccaaacttgtcccctcctgtagagtaggaagcggccgggcgccggggctgttgggggtgccaggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcagcgccgcagccgccgccgccgccgccgcagccgccgcctccagctcgcccttcgccaacgactactctgttttccaggcccccggagtttccgggggcagcggcggcggcggcgggggcggcggcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgcccaccctgcgcccgcccctctccccgacctcctcccaccaagtcctcttgggccctgtctgtccggacttcaactccagcctttccctattgcatccgactcgctctctgtctctttctgtttctgcccctcttccttcttccttctgtgacttaactttgtaaaggggatatggacaagtaagtaacacgcatcgctgtcccgggccctggctttccctttccacgggtaacgctgcctgaacccgttgcagccggaacccgcgcctcgtcgggcctttatttctcgttctctcttccttgtcctcccctcctccaccccccaggttgtgaagggcgtaacttttagagggaacggccactggaggtagagctggactaatccagtgcctggtagacagcgggcctcgcgcgggcaggagcggctcggctgacaagcctgagcggagcggtggagagggagaggctggaggcctgggcagaacagcgccgcccgggcagacggctgcttggttccagagccgctgtactgagcacctcggcttcggagcaccctgccaggcccctgggcatcgccggacgtcctactcaggctgtcggggcttggtgggggtgacttttggcagcccgagacccagagtttgtagagtttagatctcccaatgtcagtctgcctctttttctttgttccctgaggtggaaccgatgcaagtttcagcaaagggcagtcttgtcgaatcgctgcagcagctttctttcatctttatagcatatattttatttttaaaaaaactagggggaaaatagcaaccttccatttggtttcccttctataatagttttttcctctaacggggagcaatctttctctcgaaactgctaatattgatcccaaagttactttgactgcattaacttaacttacggggtgggggcgggggtgagggtaggtgcttttttcttatgcaaaaatactcctttccggtgagaccagattaactatctccatgtttgtccttttctacctcgttttttcaccactcccaaacataacctcccaatcttttttgttagtccggccgtcaattgtatagtaccaatttcgtaaattctctcaattcatgaagatcgtagggttaaacttttttgtgtgtgatttaaacttacaaacaagtgaagaagctatcgtttatttcagacgaggctgtagtttaaataccaaaagagggaaaataaaaaagaacctttgtaaaatatatctgaacctaatggtttgtacaactggagaatcgttctagattagttaccaattaaatataactccgccagtgtaagggtgtgaggtgcagttgtccaggagacgattttgtatagtatttttcttgtacattacttccagtaaatatttgaaaatatattgaagtaaacttgattttttttttttgtcacaagaaaatattaagagttattgttgcagttctgatgagctgcaggttttttgaactcacttctggaggtgcagagccacaaacgcactttcggggcctagttttgctcgaatatgaatttagataggtatcaagctgtaactaagacaatattgataaatgttggatgacatttaatttaatggagcatgtacttatttgcatttgctggcagttcaggcatagttaaagtgagagttctcctatatttcataataagtggtctgccaaaacccatgtattaaataaattgtccaagtgaaactcgactaactttggcctttgtgtatttcctgaaggtaatattgttaactgttaataaatacttctgacactacatttaaatgtttgcagattctgcaaactaattgctcattgtaatgttgaaataatttggatatttcacattgaaatgaaaagcctttctctggagcattttagatttgcattttaaatgcatgaaatgtaattgatttatttgtaatattttaaatggtataataaactcagataaaagactaggccaaaaaaaaaa

SEQ ID NO: 172 - protein, 434 aa, Homo sapiens
MLAATCNKIGSPSPSPSSLSDSSSSFGKGFHPWKRSSSSSSASCNVVGSSLSSFGVSGASRNGGSSSAAAAAAAAAAAAAALVSDSFSCGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 173 - protein, 490 aa, Homo sapiens
MLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSSAAAAAAAAAAAASSSPFANDYSVFQAPGVSGGSGGGGGGGGGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 174 - protein, 508 aa, Homo sapiens
MATSLLGEEPRLGSTPLAMLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSSAAAAAAAAAAAASSSPFANDYSVFQAPGVSGGSGGGGGGGGGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 175 - DNA, 5231 bp, Homo sapiens
ctatcagtctcgcgctcaccgcccggctgaggaggtgaaagtttctccccaggaagataaaccgcaaaagacaatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggagaagtaaggaggggcgcgctgcgcgaggcggagagagggcgaagcagtcgcggcactggcgctcacattcctctatgctacaaatccaggaggaagtttttttttagggggctgagatgctccatgcctttccccgggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacggccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatccttttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctccgtgattgtggtaggaatttcttcttcacccaccagcaacctgctgcctcttctgccagtcttaaagggtctccagaaaagctctccagtctcccttgccttccctttctgtcactgcaggtcgtataaacgtgataaatgaatgctaccctgctggctctccgagagagtgtaattagtatttatatcaaaatttatgaaacaaattttcggccgcagtataatttaaatgacctttgcagatgtagaataacaaccataaaaataacaggaatagattgcacaggcgacatcaatattaatgtagacgaattgtcagaagctcaggggctcgctctgcaacattgcaaatgaacttgcagccgagggttccgctgccccctagattaaattccccgggctgaaactgagttgcagatttacaatatcatattttaaattgctgtcttcaattaaaccatttatgaccataactaattttcaggatgtcgatgcatgcttttccaggccttccttctttgtacaaaagtaaatgtccataaagcgtttcacttatattcttcaaacatgatgctaatttaaattaattacttcctatgatatgttattattcctatgattttgccactgttattagttctctcaaaaatacatctagggaagaggattattttaagtaatttgattatctttctatctcttttatttatttctcatttacttaagaaattcgttccattggttggcattgatacagtaaatttgtaaatgaggagacaatataaaaaatctaaattacttgtgcttaatgactgtagcagaatgccttttctctaaatcagattgtctttcttgcagtttagtttgatagatttgcaagctatgctgcttccatgaagttagctgcgctggtaggaacgcaggcttctttgtctctggttgtagcttgcatgatcgccccattaggcagacaacgtagccggagatcacaaatcaggcccttggctgtagttgctagtgtgtggaggtgcagagcaggtggcagaaactgacctcactgggcaagggtggccatggacctgattctttaatgcactctatgtgttcaggaagccacaggccatatttgactctgagaaagaaaacaagaggaaaaaccccacaaagtataacaaccccttaagatacatctattttaaagtgaaattaatttttcagtttataccattggccaattacaagataaaaatgttcaatttctttaagaatcctttgttgacttgtcttttcatctcttgctatttatatttgtcactgtttcaacaaagtcttatttgctgaggaaggactttgctgcacttactgtaccacatcaaacactggggagggtggtgtttaactttttaaaaaatgttattctgattataacaataatattggcttttttcatgaaaagagcgccaccttgcaaggtttagtgagatttatggaagttgaatacctaagcaggaattgctgctagctccaaaaatttgcgaagcaaaagctagccccaattggtttggaagtttgaaactgattaacagatttgcatttgaagtgactccagacattaggtccagacattagttaaaaatagaaagaggaataaagacatctcttctctctagaaaagataacaccacaattaataatccttcccactttcattgagatcagcttgtctgataacctgatatgagtgtgataatgataaacatgataatagtggtacttttgtaattttgctggtgcatttaagaagatagtaaatgatgagttcatcttttcttcgaacattcctattcctagatgtagtttacctcaaattgggaattataactgtctaatttttgttgtgtacctgatgccccttttgctttaataccacagtgtaacaattaaatatcacactatgacatatgatttaagtaggatattttaaagataaattttaggggtaaatgtttacttcaaaatgactccatatttcaaatatctgtttagactgtgaaggccaaataatttttaagaaaacatttgaagagtagtgtgtttgcatttgtgaataatcttactcacagcaagtaaacgtaataaaagccaacatttaagccaa

SEQ ID NO: 176 - protein, 447 aa, Homo sapiens
MLLDAGPQYPAIGVTTFGASRHHSAGDVAERDVGLGINPFADGMGAFKLNPSSHELASAGQTAFTSQAPGYAAAAALGHHHHPGHVGSYSSAAFNSTRDFLFRNRGFGDAAAAASAQHSLFAASAGGFGGPHGHTDAAGHLLFPGLHEQAAGHASPNVVNGQMRLGFSGDMYPRPEQYGQVTSPRSEHYAAPQLHGYGPMNVNMAAHHGAGAFFRYMRQPIKQELICKWIEPEQLANPKKSCNKTFSTMHELVTHVTVEHVGGPEQSNHICFWEECPREGKPFKAKYKLVNHIRVHTGEKPFPCPFPGCGKVFARSENLKIHKRTHTGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 177 - DNA, 2756 bp, Homo sapiens
atgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattcatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaaaa

SEQ ID NO: 178 - protein, 686 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 179 - protein, 419 aa, Homo sapiens
MIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSMYTASENDRLTPSPTDSPRSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 180 - protein, 410 aa, Homo sapiens
MFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSMYTASENDRLTPSPTDSPRSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 181 - protein, 705 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSMYTASENDRLTPSPTDSPRSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 182 - DNA, 2428 bp, Homo sapiens
cccgcccacttccaactaccgcctccggcctgcccagggagagagagggagtggagcccagggagagggagcgcgagagagggagggaggaggggacggtgctttggctgacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacataaaaaa

SEQ ID NO: 183 - protein, 457 aa, Homo sapiens
MLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 184 - DNA, 2415 bp, Homo sapiens
cggccgctgctagaggggctgcttgcgccaggcgccggccgccccactgcgggtccctggcggccggtgtctgaggagtcggagagccgaggcggccagaccgtgcgccccgcgcttctcccgaggccgttccgggtctgaactgtaacagggaggggcctcgcaggagcagcagcgggcgagttaaagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccaaccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacataaaaaa

SEQ ID NO: 185 - protein, 463 aa, Homo sapiens
MHSASSMLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 186 - DNA, 3419 bp, Homo sapiens
ttggaggcggccggcgcaggggccgcgagaggcttcgtcgccgctgcagctccgggggctcccaggggagcgtgcgcggaacctccaggcccagcaggaccccggctgcggcgaggaggaaggagccagcctagcagcttctgcgcctgtggccgcgggtgtcctggaggcctctcggtgtgacgagtgggggacccgaaggctcgtgcgccacctccaggcctggacgctgccctccgtcttctgcccccaataggtgcgccggaccttcaggccctggggtgaattcagctgctcctacatcagcttccggaaccaccaaaaattcaaattgggattttccggagtaaacaagagcctagagccctttgctcaatgctggatttaatacgtatatatttttaagcgagttggttttttcccctttgatttttgatcttcgcgacagttcctcccacgcatattatcgttgttgccgtcgttttctctccccgcgtggctccttgacctgcgagggagagagaggacaccgaagccgggagctcgcagggaccatgtatcagagcttggccatggccgccaaccacgggccgccccccggtgcctacgaggcgggcggccccggcgccttcatgcacggcgcgggcgccgcgtcctcgccagtctacgtgcccacaccgcgggtgccctcctccgtgctgggcctgtcctacctccagggcggaggcgcgggctctgcgtccggaggcgcctcgggcggcagctccggtggggccgcgtctggtgcggggcccgggacccagcagggcagcccgggatggagccaggcgggagccgacggagccgcttacaccccgccgccggtgtcgccgcgcttctccttcccggggaccaccgggtccctggcggccgccgccgccgctgccgcggcccgggaagctgcggcctacagcagtggcggcggagcggcgggtgcgggcctggcgggccgcgagcagtacgggcgcgccggcttcgcgggctcctactccagcccctacccggcttacatggccgacgtgggcgcgtcctgggccgcagccgccgccgcctccgccggccccttcgacagcccggtcctgcacagcctgcccggccgggccaacccggccgcccgacaccccaatctcgatatgtttgacgacttctcagaaggcagagagtgtgtcaactgtggggctatgtccaccccgctctggaggcgagatgggacgggtcactatctgtgcaacgcctgcggcctctaccacaagatgaacggcatcaaccggccgctcatcaagcctcagcgccggctgtccgcctcccgccgagtgggcctctcctgtgccaactgccagaccaccaccaccacgctgtggcgccgcaatgcggagggcgagcctgtgtgcaatgcctgcggcctctacatgaagctccacggggtccccaggcctcttgcaatgcggaaagaggggatccaaaccagaaaacggaagcccaagaacctgaataaatctaagacaccagcagctccttcaggcagtgagagccttcctcccgccagcggtgcttccagcaactccagcaacgccaccaccagcagcagcgaggagatgcgtcccatcaagacggagcctggcctgtcatctcactacgggcacagcagctccgtgtcccagacgttctcagtcagtgcgatgtctggccatgggccctccatccaccctgtcctctcggccctgaagctctccccacaaggctatgcgtctcccgtcagccagtctccacagaccagctccaagcaggactcttggaacagcctggtcttggccgacagtcacggggacataatcactgcgtaatcttccctcttccctcctcaaattcctgcacggacctgggacttggaggatagcaaagaaggaggccctgggctcccaggggccggcctcctctgcctggtaatgactccagaacaacaactgggaagaaacttgaagtcgacaatctggttaggggaagcgggtgttggattttctcagatgcctttacacgctgatgggactggagggagcccacccttcagcacgagcacactgcatctctcctgtgagttggagacttctttcccaagatgtccttgtcccctgcgttccccactgtggcctagaccgtgggttttgcattgtgtttctagcaccgaggatctgagaacaagcggagggccgggccctgggacccctgctccagcccgaatgacggcatctgtttgccatgtacctggatgcgacgggcccctggggacaggcccttgccccatccatccgcttgaggcatggcaccgccctgcatccctaataccaaatctgactccaaaattgtggggtgtgacatacaagtgactgaacacttcctggggagctacaggggcacttaacccaccacagcacagcctcatcaaaatgcagctggcaacttctcccccaggtgccttccccctgctgccggcctttgctccttcacttccaacatctctcaaaataaaaatccctcttcccgctctgagcgattcagctctgcccgcagcttgtacatgtctctcccctggcaaaacaagagctgggtagtttagccaaacggcaccccctcgagttcactgcagacccttcgttcaccgtgtcacacatagaggggttctgagtaagaacaaaacgttctgctgctcaagccagtctggcaagcactcagcccagcctcgaggtccttctggggagagtgtaagtggacagagtcctggtcagggggcaggagtgtcccaagggctggcccacctgctgtctgtctgctcctcctagcccttggtcagatggcagccagagtccctcaggacctgcagcctcgccccggcagaagtcttttgtccaggaggcaaaaagccagagattctgcaacacgaattcgaagcaaacaaacacaacacaacagaattcctggaaagaagacgactgctaagacacggcaggggggcctggagggagcctccgactctgagctgctccgggatctgccgcgttctcctctgcacattgctgtttctgcccctgatgctggagctcaaggagactccttcctctttctcagcagagctgtagctgactgtggcattactacgcctccccacacgcccagacccctcactccaaaatcctactggctgtagcagagaatacctttgaaccaagattctgttttaatcatcatttacattgttttcttccaaaggccccctcgtataccctccctaacccacaaacctgttaacattgtcttaaggtgaaatggctggaaaatcagtatttaactaataaatttatctgtattcctcttaaaaaaaaaaa

SEQ ID NO: 187 - protein, 443 aa, Homo sapiens
MYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLVDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 188 - DNA, 3494 bp, Homo sapiens
ggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatg

SEQ ID NO: 189 - protein, 595 aa, Homo sapiens
MALTDGGWCLPKRFGAAGADASDSRAFPAREPSTPPSPISSSSSSCSRGGERGPGGASNCGTPQLDTEAAAGPPARSLLLSSYASHPFGAPHGPSAPGVAGPGGNLSSWEDLLLFTDLDQAATASKLLWSSRGAKLSPFAPEQPEEMYQTLAALSSQGPAAYDGAPGGFVHSAAAAAAAAAAASSPVYVPTTRVGSMLPGLPYHLQGSGSGPANHAGGAGAHPGWPQASADSPPYGSGGGAAGGGAAGPGGAGSAAAHVSARFPYSPSPPMANGAAREPGGYAAAGSGGAGGVSGGGSSLAAMGGREPQYSSLSAARPLNGTYHHHHHHHHHHPSPYSPYVGAPLTPAWPAGPFETPVLHSLQSRAGAPLPVPRGPSADLLEDLSESRECVNCGSIQTPLWRRDGTGHYLCNACGLYSKMNGLSRPLIKPQKRVPSSRRLGLSCANCHTTTTTLWRRNAEGEPVCNACGLYMKLHGVPRPLAMKKEGIQTRKRKPKNINKSKTCSGNSNNSIPMTPTSTSSNSDDCSKNTSPTTQPTASGAGAPVMTGAGESTNPENSELKYSGQDGLYIGVSLASPAEVTSSVRPDSWCALALA

SEQ ID NO: 190 - protein, 449 aa, Homo sapiens
MYQTLAALSSQGPAAYDGAPGGFVHSAAAAAAAAAAASSPVYVPTTRVGSMLPGLPYHLQGSGSGPANHAGGAGAHPGWPQASADSPPYGSGGGAAGGGAAGPGGAGSAAAHVSARFPYSPSPPMANGAAREPGGYAAAGSGGAGGVSGGGSSLAAMGGREPQYSSLSAARPLNGTYHHHHHHHHHHPSPYSPYVGAPLTPAWPAGPFETPVLHSLQSRAGAPLPVPRGPSADLLEDLSESRECVNCGSIQTPLWRRDGTGHYLCNACGLYSKMNGLSRPLIKPQKRVPSSRRLGLSCANCHTTTTTLWRRNAEGEPVCNACGLYMKLHGVPRPLAMKKEGIQTRKRKPKNINKSKTCSGNSNNSIPMTPTSTSSNSDDCSKNTSPTTQPTASGAGAPVMTGAGESTNPENSELKYSGQDGLYIGVSLASPAEVTSSVRPDSWCALALA

SEQ ID NO: 191 - DNA, 1788 bp, Homo sapiens
atggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctga

SEQ ID NO: 192 - DNA, 699 bp, Homo sapiens
atggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtatggttccagaacaggcgtgccaagtctcggcgtcagagtgggaaatccttccaacctttggctaggccggagattatcctcaaccactgtgctcctggaactgaaacgaaatgtctgaagccccagctgcctcttgaggtagatgtgaactgcctgcccgaaccaaacggggttggagggggcatctctgactctagctcccaaggtcagaattttgaaacctgttcccctctctctgaagacattggttcaaagctggactcatgggaggaacacatcttttctgcctttggtaacttttga

SEQ ID NO: 193 - protein, 232 aa, Homo sapiens
MATAESRALQFAEGAAFPAYRAPHAGGALLPPPSPAAALLPAPPAGPGPATFAGFLGRDPGPAPPPPASLGSPAPPKGAAAPSASQRRKRTSFSAEQLQLLELVFRRTRYPDIHLRERLAALTLLPESRIQVWFQNRRAKSRRQSGKSFQPLARPEIILNHCAPGTETKCLKPQLPLEVDVNCLPEPNGVGGGISDSSSQGQNFETCSPLSEDIGSKLDSWEEHIFSAFGNF

SEQ ID NO: 194 - DNA, 2350 bp, Homo sapiens
gcagtgtcactaggccggctgggggccctgggtacgctgtagaccagaccgcgacaggccagaacacgggcggcggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccctgatccgccccagcctgcaggccagaagcagtgttacacacttcctggaggagctaaggaaatcctcagactcctgggtttttgttgttgctgttgttgttttttaaaaggtgtgttggcatataatttatggtaatttattttgtctgccacttgaacagtttgggggggtgaggtttcatttaaaatttgttcagagatttgtttcccatagttggattgtcaaaaccctatttccaagttcaagttaactagctttgaatgtgtcccaaaacagcttcctccatttcctgaaagtttattgatcaaagaaatgttgtcctgggtgtgttttttcaatcttctaaaaaataaaatctggaatcctgcttttttgctctactagtacctctgtcacactagtcttatcaaaaaccagttcttaagatcaatgttaagtttattagttaatgtaaatttctcatcctcgaaaagggtgaacataaatgcctttaaggagtatatctaaaaataaacattaggatatctaagtttgatgtaattgtttcaggaaggaaaaaagaaaagcattctggaatgagcctacttcaagtaatcttagtttctaaaactaacagttaatattttcaattccagtatatcactttaagtagaaggggatgtccaagtaattttggttttctaactgttgaatcataagcttgacctgcccccagaggctttttggatgtttttatctgtgttttgccatctctttacactcctcgacattcagtttaccttaatcttcacatttttacaccttgggaagtggcaagcatcgctgggtttaagataaaggagtcacaaaaactaatcaaaataaaatttgcattatgacaacttttaataca

SEQ ID NO: 195 - protein, 414 aa, Homo sapiens [sequence omitted]

SEQ ID NO: 196 - DNA, 2518 bp, Homo sapiens
tttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatgggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaatgtgattcgtccagttattagtgaagcccctccttttgtgagtatttactgtttattg

SEQ ID NO: 197 - protein, 435 aa, Homo sapiens
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQWGWLLPGTSTLCPPANPHPQFGGALSLPSTHSCDRYPTLRSHRSSPYPSPYAHRNNSPTYSDNSPACLSMLQSHDNWSSLGMPAHPSMLPVSHNASPPTSSSQYPSLWSVSNGAVTPGSQAAAVSNGLGAQFFRGSPAHYTPLTHPVSAPSSSGSPLYEGAAAATDIVDSQYDAAAQGRLIASWTPVSPPSM

SEQ ID NO: 198 - DNA, 1308 bp, Homo sapiens
atgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatgggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtga

SEQ ID NO: 199 - DNA, 2233 bp, Homo sapiens
ggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatcctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaaaaaaaaaaaaaaaa

SEQ ID NO: 200 - DNA, 2531 bp, Homo sapiens
agggagagaactctggaggaacgctgagctgagcagcaccgaggacagcgcccggcagcgcccgcgcccaggtctccctccgcagccctgactcgcgcacacgctgagcttttgctcactccccttcgcgcggacacagacacacgcatattcacacacccagacacacaccccgctgtacaatggcagaatcccacctgcagtcatccctcatcacagcctcacagtttttcgagatctggctccatttcgacgctgacggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataacctt

SEQ ID NO: 201 - protein, 261 aa, Homo sapiens
MAESHLQSSLITASQFFEIWLHFDADGSGYLEGKELQNLIQELQQARKKAGLELSPEMKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 202 - DNA, 3366 bp, Homo sapiens
cgtgggatttccagaccgcggctttctaatcggctcgggaggaagctctgcagctctcttgggaattaagctcaatctctggactctctctctttctctttctccccctccctctcctgcgaagaagctcaagacaaaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctggggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaaaaaaaaaaaaaaaaaaaaaaaaaaaaaaaaaaaaaaaaaaaaaaaaaaaaaaaaaa

SEQ ID NO: 203 - protein, 723 aa, Homo sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 204 - protein, 247 aa, Homo sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTERESLGRHRWLTRPRTRTTRRDGAS

SEQ ID NO: 205 - DNA, 2403 bp, Homo sapiens
aagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagagggaagaaggaacagtggaggcgggacgccctccatctcctcggagccccgcgaggtccggcccagcaacttcccggcatccgcgctctagcctgaaccctggcctgggccgagcagtggcagcagagagtggcctcggagggaagccactgccacctgagacagcccaagcagcaagataaacccgctccacccgacccgccgaccttcagctttgtgggactatcaggaaaaaacaaaacaaaaacaaaatgtagaaaaagcaaaagctcttttctgtcctgtcagtctcctgtctccttttgctctgtctgtgcgctggtaaagtccaggtcctcatccgtccgctgtcctcattctgcggcctcagcaaaaagccacaaggtctgagcggcccgggtcctgccgggctgaccatctccggatcctgggacactctgcctgaccatctgtgtagctggtgtgggaatctgggggcattggagggagggggttttatttattgagaaatggacttcgcctgaggctgtttgccaattcagggttctgctgggcgcaaggaacgcactgttcaaacgcactgtttactttaagcgcacggggagaaacgaataaggaggacgtggtgatttttaatttatacagtaacttttgtacttctctggtatggagagtttggagccgaatgatttgcattttttacatgtccgacattatttaataaataatttttaaaagaaaagaacgataaatgaagccaacatgattttctcatttcgggaggaactctgttgcttcgcctggacaagaaggaaaatgctgatttcctccttgggtagaaagagggagcgagggcaaatggggagtagagagaaaacaggcgagaacaagcactctaattccagtgggctttaaaataagacaaaatcagctttacaacaatccctagaggctcgaccacagaataatgccagtcaccaccctgaacgcacaatctccagtgcaggatctaatgactgtacatattattgttattattattattgttattattgttgttctgtaaacatgttgcacaagcttagcctttttgcgttctgttgtgtgtggctgtaaaaccccatgctttgtgaaatgagaatcttgacatttttcttgtgaaatttggaaaatgtgatcaattgaaatcaactgtgttttgtgttctctatgtcaaagtttagttttatattgagaatgttaacttattgctttgtatcttgggaaaaaaactttgtaaataagttataaagtttctttgagacagtaaaattatgatttcttgaaaaaaaaaaaaaaaaaaaaaaa

SEQ ID NO: 206 - protein, 255 aa, Homo sapiens
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGADSEKSTVVEGGEVRFNGKGKKIRKPRTIYSSLQLQALNRRFQQTQYLALPERAELAASLGLTQTQVKIWFQNKRSKFKKLMKQGGAALEGSALANGRALSAGSPPVPPGWNPNSSSGKGSGGNAGSYIPSYTSWYPSAHQEAMQQPQLM

SEQ ID NO: 207 - DNA, 390 bp, Homo sapiens
atgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggtcaagatctggttccaaaacaagcgatccaagttcaagaagctgatgaagcagggtggggcggctctggagggtag

SEQ ID NO: 208 - protein, 129 aa, Homo sapiens
MTMTTMPESLNSPVSGKAVFMEFGPPNQQMSPSPMSHGHYSMHCLHSAGHSQPDGAYSSASSFSRPLGYPYVNSVSSHASSPYISSVQSYPGSASLAQSRLEDPGQDLVPKQAIQVQEADEAGWGGSGG

SEQ ID NO: 209 - DNA, 2308 bp, Homo sapiens
aagaggatgcgaccagaggcagctgtcccgagcagcgcacggtgatcgcctcccccggaggaggaggcgcctagacggttgcctcctttcttgtttccccaccaccacccccgtaattacattggctgctggaggggaccgggagagacagaggaggcgcctggcttcccccgcacgcccgccacctctgctctttcccgtctcgggccaggatgactggagtctttgacagtctagtggctgatatgcactcgacccagatcgccgcctccagcacgtaccaccagcaccagcagcccccgagcggcggcggcgccggcccgggtggcaacagcagcagcagcagcagcctccacaagccccaggagtcgcccacccttccggtgtccaccgccaccgacagcagctactacaccaaccagcagcacccggcgggcggcggcggcggcgggggctcgccctacgcgcacatgggttcctaccagtaccaagccagcggcctcaacaacgtcccttactccgccaagagcagctatgacctgggctacaccgccgcctacacctcctacgctccctatggaaccagttcgtccccagccaacaacgagcctgagaaggaggaccttgagcctgaaattcggatagtgaacgggaagccaaagaaagtccggaaaccccgcaccatctactccagtttccagctggcggctcttcagcggcgtttccaaaagactcaatacttggccttgccggagcgagccgagctggcggcctctctgggcctcacccagactcaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcggggacgattttctaaccccagggagaactcgccagagactgagagcagagaccacttatcctcattgcttaccccgagccggggttccctcctcccggcccgctgccgccacccacctctcctgcaggctgcgacctgcagtggcccgtctcaggccctgctcactcccggggccaccaaacgggcccctctctcgggggaaccggacagcagcttggcaaaggcctccctaaaaggccgcatttctgacctgagccccgggtctcggctgtttcgagccccgcctcggacttgccttccctcccctccgggtgagcctgtctggcgccttcctcgccccgggctgagagctgggtcccgggagatggaagcctcccaggcgcgcgaggcttcccgggcgctctgaggcttctttctcctcgcccgctcccctgggctcagctcggacgctgcagttattgacctcccggtcccgcctgcccgccctcccccacgtggccccttgacccgggcggccccgccgcttctttccttcctgcagttcccagccctcggagcccccatcccttatcttacccccaccgcgctcccccaggagcgctccctcagctctctcctcatccatcaccagtggagtttttttatttgttatttttttaaaagtttaggtgcctttgcggatgacctcattttgacgttgaaaaaatgattttttaatatgtgaacactgcaaaaatgtgtttaaattatcttttttaaaacctattcaggattattagcctggacttggacacagagtttgtaaataaaggtgtctgtgcagattttcccactgatttatttgtataaaaatactcatcttttcagacttttttgtaaacccccagttgtgaaaactgcagtttagcagtgacctcagcaacccctcctttttattttttcctttaaaaacatttcagttaaattaagctactgatttggatttgttttatcgtatcctaaagtctttgttgttgaaatgaaaggtattttggggttatttattatgaaaacaacatgctcttaatgttgattttacaatatgaagagattatttaaataaattattgttttcattggaaaaa

SEQ ID NO: 210 - protein, 329 aa, Homo sapiens
MTGVFDSLVADMHSTQQIAASSTYHQHQQPPSGGGAGPGGNSSSSSSLHKPQESPTLPVSTATDSSYYTNQQHPAGGGGGGGSPYAHMGSYQYQASGLNNVPYSAKSSYDLGYTAAYTSYAPYGTSSSPANNEPEKEDLEPEIRIVNGKPKKVRKPRTIYSSFQLAALQRRFQKTQYLALPERAELAASLGLTQTQVKIWFQNRRSKFKKMWKSGEIPSEQHPGASASPPCASPPVSAPASWDFGVPQRMAGGGGPGSGGSGAGSSGSSPSSAASAFLGNYPWYHQTSGSASHLQATAPLLHPTQTPQPHHHHHHHGGGGAPVSAGTIF

SEQ ID NO: 211 - protein, 217 aa, Homo sapiens
MTGVFDSLVADMHSTQIAASSTYHQHQQPPSGGGAGPGGNSSSSSSLHKPQESPTLPVSTATDSSYYTNQQHPAGGGGGGGSPYAHMGSYQYQASGLNNVPYSAKSSYDLGYTAAYTSYAPYGTSSSPANNEPEKEDLEPEIRIVNGKPKKVRKPRTIYSSFQLAALQRRFQKTQYLALPERAELAASLGLTQTQVGLAPCRGEESAGLRWLGSRRV

SEQ ID NO: 212 - DNA, 966 bp, Homo sapiens
atgggggaatggaccatcttggagaggctgctagaagccgcggtgcagcagcactccactatgatcggaaggatcctgttgactgtggtggtgatcttccggatcctcattgtggccattgtgggggagacggtgtacgatgatgagcagaccatgtttgtgtgcaacaccctgcagcccggctgtaaccaggcctgctatgaccgggccttccccatctcccacatacgttactgggtcttccagatcataatggtgtgtacccccagtctttgcttcatcacctactctgtgcaccagtccgccaagcagcgagaacgccgctactctacagtcttcctagccctggacagagacccccctgagtccataggaggtcctggaggaactgggggtgggggcagtggtgggggcaaacgagaagataagaagttgcaaaatgctattgtgaatggggtgctgcagaacacagagaacaccagtaaggagacagagccagattgtttagaggttaaggagctgactccacacccatcaggtctacgcactgcatcaaaatccaagctcagaaggcaggaaggcatctcccgcttctacattatccaagtggtgttccgaaatgccctggaaattgggttcctggttggccaatattttctctatggctttagtgtcccagggttgtatgagtgtaaccgctacccctgcatcaaggaggtggaatgttatgtgtcccggccaactgagaagactgtctttctagtgttcatgtttgctgtaagtggcatctgtgttgtgctcaacctggctgaactcaaccacctgggatggcgcaagatcaagctggctgtgcgaggggctcaggccaagagaaagtcaatctatgagattcgtaacaaggacctgccaagggtcagtgttcccaattttggcaggactcagtccagtgactctgcctatgtgtga

SEQ ID NO: 213 - protein, 321 aa, Homo sapiens
MGEWTILERLLEAAVQQHSTMIGRILLTVVVIFRILIVAIVGETVYDDEQTMFVCNTLQPGCNQACYDRAFPISHIRYWVFQIIMVCTPSLCFITYSVHQSAKQRERRYSTVFLALDRDPPESIGGPGGTGGGGSGGGKREDKKLQNAIVNGVLQNTENTSKETEPDCLEVKELTPHPSGLRTASKSKLRRQEGISRFYIIQVVFRNALEIGFLVGQYFLYGFSVPGLYECNRYPCIKEVECYVSRPTEKTVFLVFMFAVSGICVVLNLAELNHLGWRKIKLAVRGAQAKRKSIYEIRNKDLPRVSVPNFGRTQSSDSAYV

SEQ ID NO: 214 - DNA, 1096 bp, Homo sapiens
tcccattctggaagtgcggcccggggaggggccaggagcgggaacgtgcccggtgctgcccagtctttgtctgctgcctccggatgcacagcgatgggggaatggaccatcttggagaggctgctagaagccgcggtgcagcagcactccactatgatcgggaggatcctgttgactgtggtggtgatcttccggatcctcattgtggccattgtgggggagacggtgtacgatgatgagcagaccatgtttgtgtgcaacaccctgcagcccggctgtaaccaggcctgctatgaccgcgccttccccatctcccacatacgttactgggtcttccagatcataatggtgtgtacccccagtctttgcttcatcacctactctgtgcaccagtccgccaagcagcgagaacgccgctactctacagtcttcctagccctggacagagacccccctgagtccataggaggtcctggaggaactgggggtgggggcagtggtgggggcaaacgagaagataagaagttgcaaaatgctattgtgaatggggtgctgcagaacacagagaacaccagtaaggagacagagccagattgtttagaggttaaggagctgactccacacccatcaggtctacgcactgcatcaaaatccaagctcagaaggcaggaaggcatctcccgcttctacattatccaagtggtgttccgaaatgccctggaaattgggttcctggttggccaatattttctctatggctttagtgtcccagggttgtatgagtgtaaccgctacccctgcatcaaggaggtggaatgttatgtgtcccggccaactgagaagactgtctttctagtgttcatgtttgctgtaagtggcatctgtgttgtgctcaacctggctgaactcaaccacctgggatggcgcaagatcaagctggctgtgcgaggggctcaggccaagagaaagtcaatctatgagattcgtaacaaggacctgccaagggtcagtgttcccaattttggcaggactcagtccagtgactctgcctatgtgtgagagggcaggtttcatgaaggtctgggggatggcaagg

SEQ ID NO: 215 - DNA, 1471 bp, Homo sapiens
atcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcaaaaaaaaaaaaaaaaaa

SEQ ID NO: 216 - protein, 280 aa, Homo sapiens
MPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPPGGAPCKLGSQAGEAAKVFGGFQVVPAPDGQFAFLIPNGAFAHSGPVIPVYTSNSGTSVGPNAVSPSSGPSLTADSMWRPWRN

SEQ ID NO: 217 - DNA, 843 bp, Homo sapiens
atgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactga

SEQ ID NO: 218 - DNA, 697 bp, Homo sapiens
tgggcacggagcctgctgcccggggcagcctccccggcaacttccgaaagatttccaagccgctgatggagaaaaagcgccgggcacgcatcaatgtgtcactggagcagctcaagtcgctgctggagaaacactactcgcaccagatccggaagcgcaaattggagaaggccgacatcctggagttgagcgtgaagtacatgagaagccttcagaactccttgcaagggctctggcctgtgcccaggggagccgagcaaccgtcgggcttccgcagctgcctgcccggcgtgagccagctccttcggcgcggagatgaggtcggcagcggcctgcgctgccccctggtgcccgagagcgccgccggcagcaccatggacagcgccgggttgggccaggaggcgcccgcgctgttccgcccttgcacccctgccgtctgggctcctgctccggccgccggcggcccgcggtccccaccacccctgctcctcctccccgaaagtctccctggctcgtccgccagcgtccccccgccgcagccagcgtcgagtcgctgcgccgagagtcccgggctgggcctgcgcgtgtggcggccctggggaagccccggggatgacctgaactgaaggcgctccctatttggtctcgcgacacagggactattttcagcacgcccacagtgactgccaggaccccc

SEQ ID NO: 219 - protein, 186 aa, Homo sapiens
MEKKRRARINVSLEQLKSLLEKHYSHQIRKRKLEKADILELSVKYMRSLQNSLQGLWPVPRGAEQPSGFRSCLPGVSQLLRRGDEVGSGLRCPLVPESAAGSTMDSAGLGQEAPALFRPCTPAVWAPAPAAGGPRSPPPLLLLPESLPGSSASVPPPQPASSRCAESPGLGLRVWRPWGSPGDDLN

SEQ ID NO: 220 - DNA, 1319 bp, Homo sapiens
cgcgcttggccttgcccgcgcccgctcgcctcgtctcgcccggcctccccgcgtcgcctcgtcgcctgttccgcgccaggcatggcccccagcactgtggccgtggagctgctcagccccaaagagaaaaaccgactgcggaagccggtggtggagaagatgcgccgcgaccgcatcaacagcagcatcgagcagctgaagctgctgctggagcaggagttcgcgcggcaccagcccaactccaagctggagaaggccgacatcctggagatggctgtcagctacctgaagcacagcaaagccttcgtcgccgccgccggccccaagagcctgcaccaggactacagcgaaggctactcgtggtgcctgcaggaggccgtgcagttcctgacgctccacgccgccagcgacacgcagatgaagctgctgtaccacttccagcggcccccggccgcgcccgccgcgcccgccaaggagcccaaggcgccgggcgccgcgcccccgcccgcgctctccgccaaggccaccgccgccgccgccgccgcgcaccagcccgcctgcggcctctggcggccctggtgacccggcgggacctgcgggcgcgcggcccgacgaccagagggcgagcctgctcctctcgcctgtagggaagcgccttcccgccgtcgtccgccccgggcttggacgcgcccttctccggaaggctctggccccaagctggccggcccgcaggagccccattctcagagaatgtgtgtgcagagtccctgccgttttaggacaatcagggcccatcttctgccaagtgtctgaccccatggggttgttctgtgtttgcatttaagcaagtgacttctgggaagtccccggccgcccggggttctatgatatttgtagtgccggggctcgcacactgctgcccccagcctgtagaggactttcttcagggcccgtagctgctgggcgtacccctggcaggcgggctgtgccgcgggcacatttgccttttgtgaaggccgaactcgagctgtatcctcataggaaacagtgatcaccccggacgggcgtccaggaccctgagggccatggccaaaaggctcctgagtgtgcctggtggtctggctggggctcacggtgggctgtctggggagggtgggtgcctccactatgatccttaaaggattcctctgtgtgggtggatgcgtgtgggcacgactttgtactcagaaattgaactctcagtcacgtggaagccacgggactgctccgaagccgccataataaaatctgattgttcagcccccaaaaaaaaaaaaaaa

SEQ ID NO: 221 - protein, 166 aa, Homo sapiens
MAPSTVAVELLSPKEKNRLRKPVVEKMRRDRINSSIEQLKLLLEQEFARHQPNSKLEKADILEMAVSYLKHSKAFVAAAGPKSLHQDYSEGYSWCLQEAVQFLTLHAASDTQMKLLYHFQRPPAAPAAPAKEPKAPGAAPPPALSAKATAAAAAAHQPACGLWRPW

SEQ ID NO: 222 - DNA, 1014 bp, Homo sapiens
tgacgcatggactataataggatgaactccttcttagagtacccactctgtaaccggggacccagcgcctacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctccgcgccctcggggtatgctcctgccgcctgcagccccagctacgggccttctcagtactaccctctgggtcaatcagaaggagacggaggctattttcatccctcgagctacggggcccagctagggggcttgtccgatggctacggagcaggtggagccggtccggggccatatcctccgcagcatcccccttatgggaacgagcagaccgcgagctttgcaccggcctatgctgatctcctctccgaggacaaggaaacaccctgcccttcagaacctaacacccccacggcccggaccttcgactggatgaaggttaagagaaacccacccaagacagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagaggaaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtccagccctatcccaggctctccccaaccccaggcctgggcttcactggcctggg

SEQ ID NO: 223 - protein, 301 aa, Homo sapiens
MDYNRMNSFLEYPLCNRGPSAYSAHSAPTSFPPSSAQAVDSYASEGRYGGGLSSPAFQQNSGYPAQQPPSTLGVPFPSSAPSGYAPAACSPSYGPSQYYPLGQSEGDGGYFHPSSYGAQLGGLSDGYGAGGAGPGPYPPQHPPYGNEQTASFAPAYADLLSEDKETPCPSEPNTPTARTFDWMKVKRNPPKTAKVSEPGLGSPSGLRTNFTTRQLTELEKEFHFNKYLSRARRVEIAATLELNETQVKIWFQNRRMKQKKREREEGRVPPAPPGCPKEAAGDASDQSTCTSPEASPSSVTS

SEQ ID NO: 224 - protein, 232 aa, Homo sapiens
MDYNRMNSFLEYPLCNRGPSAYSAHSAPTSFPPSSAQAVDSYASEGRYGGGLSSPAFQQNSGYPAQQPPSTLGVPFPSSAPSGYAPAACSPSYGPSQYYPLGQSEGDGGYFHPSSYGAQLGGLSDGYGAGGAGPGPYPPQHPPYGNEQTASFAPAYADLLSEDKETPCPSEPNTPTARTFDWMKVKRNPPKTGRAQMWPPLLRGPKHLCFPCSDMSWVWAGFFSFSGSGRHR

SEQ ID NO: 225 - DNA, 2176 bp, Homo sapiens
cagcggcctccgcgcggtcgcctgagggctgcagcgcaaagaaccgggctcccgggcccggacgcggggaagcactcgcgtgggagtttgtgcgagcgcggcccggggcggggcccgcacggaggaggcgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgatggaaaaatccaaaaatttccgcatcgacgccctgctggcggtggaccccccacgagccgcctctgcgcagagcgcgccgctggccttggtcacgtcgctcgccgccgccgcatctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggcacgggcggcgggcacggggggccccaccaccacgcgcatccgggcgcagcggccgctgccgccgccgccgccgccgccgccgccgctgggggcctggcgctggggctgcaccctgggggcgcgcagggcggcgcgggcctcccggcgcaggcggcgctctacggccacccggtctacggctactccgcggcggcggcggcggctgcgctggcgggccagcacccggcgctctcctactcgtacccgcaggtgcaaggcgcgcaccccgcgcaccccgccgaccccatcaagctgggcgccggcaccttccagctggaccagtggctgcgcgcgtccaccgcgggcatgatcctgcctaagatgcccgacttcaactcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggat

SEQ ID NO: 226 - protein, 401 aa, Homo sapiens
MEKSKNFRIDALLAVDPPRAASAQSAPLALVTSLAAAASGTGGGGGGGGASGGTSGSCSPASSEPPAAPADRLRAESPSPPRLLAAHCALLPKPGFLGAGGGGGGTGGGHGGPHHHAHPGAAAAAAAAAAAAAAGGLALGLHPGGAQGGAGLPAQAALYGHPVYGYSAAAAAAALAGQHPALSYSYPQVQGAHPAHPADPIKLGAGTFQLDQWLRASTAGMILPKMPDFNSQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 227 - DNA, 1620 bp, Homo sapiens
tctcttaacgggaaggggcagttggaggtgtgagactgagatctaatgattaacccgaaggctgcaggagaaggaagtcgccgggggaaggcgagccgagagcgccctgaattaggcaggcccgggaatgggggtcagggcttatcaccggggaaaggaacttgggccaggtcccccactggggcgttagagagacccgcggcccctccagggagagggagtgcttcaggagcagcaaacaagagaaatgggcttcggaggcccggggaggcaaggccaaggcccagggaacccccggctcttaccagggcgctgccctcctctggaagggcgttggatccggggtgcgatggccgaggcaggtggcctggcttgaaccagctatggggggactctcaacagtaggtgcctgccctggaatcctgggcgcccaacaagcccaggcgcagtcgaacctcctggggaagtgccgccggccgcgcaccgccttcaccagccagcagctgctggagctggagcaccagttcaagctcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggat

SEQ ID NO: 228 - protein, 189 aa, Homo sapiens
MGGLSTVGACPGILGAQQAQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 229 - DNA, 2641 bp, Homo sapiens
gagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaagccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgaaaaaaaaaaaa

SEQ ID NO: 230 - protein, 356 aa, Homo sapiens
MTKSYSESGLMGEPQPQGPPSWTDECLSSQDEEHEADKKEDDLETMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 231 - DNA, 1979 bp, Homo sapiens
ggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaagccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaa

SEQ ID NO: 232 - DNA, 1717 bp, Homo sapiens
cacacgagctgatctgatcgccggcgacatcactcaggagaccggccgggcgcgtggcccctgcaggcgaggcgaggaggccaggccaagttctccgtgcgcccctgcacccttccaggctctcgcacccgcaactggcacagagtaacaaccccaggctgttgggaacgtaagtgcgccctggcggctctgccctcagtccgggctgcagcgctctgagcgcctttctatctgtccgtcggtcctgcacagcgcaacgatgccagcccgccttgagacctgcatctccgacctcgactgcgccagcagcagcggcagtgacctatccggcttcctcaccgacgaggaagactgtgccagactccaacaggcagcctccgcttcggggccgcccgcgccggcccgcaggggcgcgcccaatatctcccgggcgtctgaggttccaggggcacaggacgacgagcaggagaggcggcggcgccgcggccggacgcgggtccgctccgaggcgctgctgcactcgctgcgcaggagccggcgcgtcaaggccaacgatcgcgagcgcaaccgcatgcacaacttgaacgcggccctggacgcactgcgcagcgtgctgccctcgttccccgacgacaccaagctcaccaaaatcgagacgctgcgcttcgcctacaactacatctgggctctggccgagacactgcgcctggcggatcaagggctgcccggaggcggtgcccgggagcgcctcctgccgccgcagtgcgtcccctgcctgcccggtcccccaagccccgccagcgacgcggagtcctggggctcaggtgccgccgccgcctccccgctctctgaccccagtagcccagccgcctccgaagacttcacctaccgccccggcgaccctgttttctccttcccaagcctgcccaaagacttgctccacacaacgccctgtttcattccttaccactaggccctttgtagacactgttactttccccctcccctagtcagcaggcaatagatggggccccagctgccgcctcgggaccccctctccaggcggagggaggaagcgggagctttaaagcagtcggggatacctgagccgcttgttaggtcgccgcaccctcgcggcggatgtctcttggtctgtttctccggccctcagcccagcgcccctcctgcccgcccctagacggcctttccttttgcactttctgaactccacaaaacctcctttgtgactggctcagaactgaccccagccaccacttcagtgtgatttagaaaagggacagatcagcccctgaagacgaggtgaaaagtcaattttacaatttgtagaactctaatgaagaaaaacgagcatgaaaattcggtttgagccggctgacaatacaatgaaaaggcttaaaaagcagagacaaggagtgggcttcatgcattatggatcccgacccccaccactgcagactcgctctaggaagaactggagactcttgcttagctattcaggcacagggctggagagtactttaatttattcaagatgcttcattcatatgaaaatgtatttttgtacataaagagtttattctattatgagctatcaaagtttacatttttgtactgcagacgcttcatgtaaataaaaactaaaaataaaaaaaaaaaaaaaaaaaaaaaaaaaaaaaaaaaaaaaaaaaaaaaaaaa

SEQ ID NO: 233 - protein, 237 aa, Homo sapiens
MPARLETCISDLDCASSSGSDLSGFLTDEEDCARLQQAASASGPPAPARRGAPNISRASEVPGAQDDEQERRRRRGRTRVRSEALLHSLRRSRRVKANDRERNRMHNLNAALDALRSVLPSFPDDTKLTKIETLRFAYNYIWALAETLRLADQGLPGGGARERLLPPQCVPCLPGPPSPASDAESWGSGAAAASPLSDPSSPAASEDFTYRPGDPVFSFPSLPKDLLHTTPCFIPYH

SEQ ID NO: 234 - DNA, 2267 bp, Homo sapiens
cgcagccactgaaccacaagcagcttcgcgttaactggagtgcctgggagtcgcgtgccaggagccgcacggccagggactgactgacagacagacacgcaccaccaccacaacacacgagacccgggcgggccgccgccgccgccgccggggctcttggcaaactcgccggtcgcagaggtcccccgcggagctgcgccacagtagcgccgggcttgcagctttcacgccgggcgaaggacccggcgctgcgctcgcagctgcgcggagattcccggcacaggccaaagtcacagcaacgctgaggcacagttagagccaactaagatgttcgtcaaatccgagaccttggagttgaaggaggaagaggacgtgttagtgctgctcggatcggcctcccccgccttggcggccctgaccccgctgtcatccagcgccgacgaagaagaggaggaggagccgggcgcgtcaggcggggcgcgtcggcagcgcggggctgaggccgggcagggggcgcggggcggcgtggctgcgggtgcggagggctgccggcccgcacggctgctgggtctggtacacgattgcaaacggcgcccttcccgggcgcgggccgtctcccgaggcgccaagacggccgagacggtgcagcgcatcaagaagacccgtagactgaaggccaacaaccgcgagcgaaaccgcatgcacaacctcaacgcggcactggacgcgctgcgcgaggtgctccccacgttccccgaggacgccaagctcaccaagatcgagaccctgcgcttcgcccacaactacatctgggcactcaccgagaccctgcgcctggcggatcactgcgggggcggcggcgggggcctgccgggggcgctcttctccgaggcagtgttgctgagcccgggaggcgccagcgccgccctgagcagcagcggagacagcccctcgcccgcctccacgtggagttgcaccaacagccccgcgccgtcctcctccgtgtcctccaattccacctccccctacagctgcactttatcgcccgccagcccggccgggtcagacatggactattggcagcccccacctcccgacaagcaccgctatgcacctcacctccccatagccagggattgtatctagagctgccatttctgctacccacgccaggccttagtgggttccctttcctgtccccagtcgagccctcctcccttcccctgcccctcctttccacgccctggaaaccatctcacttcacagggcaggtgtagcctttctgattcctcggttgtttcttgcatttcttggctttgggtatccttcattcagacgggctctgatttactgaaggtgtgatggagcttattgtcaaagccaagggtggcgttttgggggcgcttcttgagacgaaaaagaccctgggaagagatgatggtggcatatctaaagagtttgcagagcggactgacgctcctcccctttctctttaacgccgaaggacttggtgcagttcgtgtgaatctcacagggggaatgcaactggttcctgtgatctcttcacctttgcttctacatagagatgttaatgtcgagtagaaagaaatgtatcttagcatctgaatgattttgctggtaataatattatccacagatttgcaatggctggcatctgctttattcccattgctgtctgcaggctgtgggaatttcacctgtcaaaccaaacttccctctctgatgtgcactttgttctgtttcccagattcgtcacaatgcctattgtcctgtccttctctttcctttttcttccccattttgccatctgtctcttatgatttataaggggaaaaaaacttgttttgttagaggggcaggttagaagtcattgtataatttgtaggctttgtaatgattgaatgcaagcgtggaaatttaggctgaactctctatcaaaaggaaaaatgtggaggaaaagggaaaaatcaggagggaggattgcctcatgtattatttatttcgaccttttaggggagaaggaactcccccattctttcaagagattaaaaataaatcaacagtctgaaaacctaagcagacacggagcattatccggatcagccacacacgtgttcccttctatttattataaagaaatttttcatgggaaaatatgtattttttgtatattctacagagtttattctagtatgtatttacatcttgaagaacaagaaagttgttcttgtgattaaactataaat

SEQ ID NO: 235 - protein, 272 aa, Homo sapiens
MFVKSETLELKEEEDVLVLLGSASPALAALTPLSSSADEEEEEEPGASGGARRQRGAEAGQGARGGVAAGAEGCRPARLLGLVHDCKRRPSRARAVSRGAKTAETVQRIKKTRRLKANNRERNRMHNLNAALDALREVLPTFPEDAKLTKIETLRFAHNYIWALTETLRLADHCGGGGGGLPGALFSEAVLLSPGGASAALSSSGDSPSPASTWSCTNSPAPSSSVSSNSTSPYSCTLSPASPAGSDMDYWQPPPPDKHRYAPHLPIARDCI

SEQ ID NO: 236 - DNA, 1116 bp, Homo sapiens
cgtgggatgttagcggtgggggcaatggagggcacccggcagagcgcattcctgctcagcagccctcccctggccgccctgcacagcatggccgagatgaagaccccgctgtaccctgccgcgtatcccccgctgcctgccggccccccctcctcctcgtcctcgtcgtcgtcctcctcgtcgccctccccgcctctgggcacccacaacccaggcggcctgaagcccccggccacgggggggctctcatccctcggcagccccccgcagcagctctcggccgccaccccacacggcatcaacgatatcctgagccggccctccatgcccgtggcctcgggggccgccctgccctccgcctcgccctccggttcctcctcctcctcttcctcgtccgcctctgcctcctccgcctctgccgccgccgcggctgctgccgcggccgcagccgccgcctcatccccggcggggctgctggccggactgccacgctttagcagcctgagcccgccgccgccgccgcccgggctctacttcagccccagcgccgcggccgtggccgccgtgggccggtaccccaagccgctggctgagctgcctggccggacgcccatcttctggcccggagtgatgcagagcccgccctggagggacgcacgcctggcctgtacccctcatcaaggatccattttgttggacaaagacgggaagagaaaacacacgagacccactttttccggacagcagatcttcgccctggagaagactttcgaacaaacaaaatacttggcggggcccgagagggctcgtttggcctattcgttggggatgacagagagtcaggtcaaggtctggttccagaaccgccggaccaagtggaggaagaagcacgctgccgagatggccacggccaagaagaagcaggactcggagacagagcgcctcaagggggcctcggagaacgaggaagaggacgacgactacaataagcctctggatcccaactcggacgacgagaaaatcacgcagctgttgaagaagcacaagtccagcagcggcggcggcggcggcctcctactgcacgcgtccgagccggagagctcatcctgaacgccg

SEQ ID NO: 237 - protein, 367 aa, Homo sapiens
MLAVGAMEGTRQSAFLLSSPPLAALHSMAEMKTPLYPAAYPPLPAGPPSSSSSSSSSSSPSPPLGTHNPGGLKPPATGGLSSLGSPPQQLSAATPHGINDILSRPSMPVASGAALPSASPSGSSSSSSSSASASSASAAAAAAAAAAAAASSPAGLLAGLPRFSSLSPPPPPPGLYFSPSAAAVAAVGRYPKPLAELPGRTPIFWPGVMQSPPWRDARLACTPHQGSILLDKDGKRKHTRPTFSGQQIFALEKTFEQTKYLAGPERARLAYSLGMTESQVKVWFQNRRTKWRKKHAAEMATAKKKQDSETERLKGASENEEEDDDYNKPLDPNSDDEKITQLLKKHKSSSGGGGGLLLHASEPESSS

SEQ ID NO: 238 - DNA, 6947 bp, Homo sapiens
ggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 239 - DNA, 6823 bp, Homo sapiens
tgtcagatctgccacttcccctgccgagcggcggtgagaagtgtgggaaccggcgctgccaggctcacctgcctccccgccctccgctcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 240 - DNA, 6891 bp, Homo sapiens
ggtgcatttgcatgttgcggagtgattagtgggtttgaaaagggaaccgtggctcggcctcatttcccgctctggttcaggcgcaggaggaagtgttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 241 - protein, 422 aa, Homo sapiens [sequence omitted]

SEQ ID NO: 242 - protein, 436 aa, Homo sapiens
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 243 - DNA, 6969 bp, Homo sapiens
aatattttgtgtgagagcgagcggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 244 - DNA, 6913 bp, Homo sapiens
aatattttgtgtgagagcgagcggtgcatttgcatgttgcggagtgattagtgggtttgaaaagggaaccgtggctcggcctcatttcccgctctggttcaggcgcaggaggaagtgttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 245 - DNA, 6857 bp, Homo sapiens
acacttgagccatcaccaatcagcataggtgtgctggctgcagccacttccctcacccacactctttatctctcactctccagccgctgacagcccattttattgtcaatctctgtctccttcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 246 - DNA, 6803 bp, Homo sapiens
gggcttttcacaagaaccctctgtacacaaagaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 247 - DNA, 6871 bp, Homo sapiens
aatattttgtgtgagagcgagcggtgcatttgcatgttgcggagtgattagtgggtttgaaaagggaaccgtggctcggcctcatttcccgctctggttcaggcgcaggaggaagtgttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 248 - DNA, 6925 bp, Homo sapiens
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 249 - DNA, 2533 bp, Homo sapiens
gcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctcctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcagacaccggcacctccatcctctcggtaacctccagcgactcggaatgtgatgtatgatagccaaggccgccctcctccctctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatatataaaaaacaagaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaatcgccgtctccgttccgaatttgttaaaaaaaaaaaaaaaaaaaaaaaaaaggacagggggaaaaaaaaaaaaaaagaactcctggagagggaaatagcaaatgtgtcttgccttttgttgctctctctctctttttttttctctcgctctctttctttctcttcttctctctgtttttaagtcaagtattggtcaaaaaaatgcaatcttctgttttttgttcagcagacaatcattttcttcgtaagcacctttttctctccactctgtcactgcctgtgtgggtactggttataaatgtggaaaaagaatagttatgactgtaacagatttttatttttatttcaaaattttatatgaattatgtatatcttaatgatcggtcattttcccagtttgtaatatatgtgtagaaattgcctgtatatgatattgctttttctcctctccctttctctttctctcctctccctctctctgtctttctccccgctcaactgtctcttttctttttggggttctcctcccactcggtgctcctggtgtcgacttggcagtcaaggagaggcatggtggcctgggttaggaagagggaccctgtcgctagcaaaagcggagagtgagattgtagtattcttatgcaaaagctatttccagtatttcttagcagcttcagaggtatctctcactccctgtagggcgcttttactgttatcttaaactgcgtgtttatctatatgtaaaaactttctaaagcaaatacagtattctccattttcttatcactcccaaaaaaaaaaa

SEQ ID NO: 250 - protein, 332 aa, Homo sapiens
MVFRSPLDLYSSHFLLPNFADSHHRSILLASSGGGNGAGGGGGAGGGSGGGNGAGGGGAGGAGGGGGGGSRAPPEELSMFQLPTLNFSPEQVASVCETLEETGDIERLGRFLWSLPVAPGACEAINKHESILRARAVVAFHTGNFRDLYHILENHKFTKESHGKLQAMWLEAHYQEAEKLRGRPLGPVDKYRVRKKFPLPRTIWDGEQKTHCFKERTRSLLREWYLQDPYPNPSKKRELAQATGLTPTQVGNWFKNRRQRDRAAAAKNRLQHQAIGPSGMRSLAEPGCPTHGSAESPSTAASPTTSVSSLTERADTGTSILSVTSSDSECDV

SEQ ID NO: 251 - DNA, 1689 bp, Homo sapiens
ctggcatcttcctcccctcctcctttccagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgacaaaaaaaaaaaaaaaaaa

SEQ ID NO: 252 - DNA, 1728 bp, Homo sapiens
gccgggccgagccgagcgccgagcagggagcgggcggccgcgctccgggccggggtcccgggggagcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgacaaaaaaaaaaaaaaaaaa

SEQ ID NO: 253 - protein, 483 aa, Homo sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 254 - DNA, 1669 bp, Homo sapiens
gctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaccccg

SEQ ID NO: 255 - DNA, 1700 bp, Homo sapiens
agcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgacaaaaaaaaaaaaaaaaaa

SEQ ID NO: 256 - protein, 470 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 257 - DNA, 1749 bp, Homo sapiens
gcggtcttatataagccagatccgcaggggagtccgcagaagggttaaacaggtctttgggcttcggcgacctcgcccgcggcagaaaccggtaagaagacagtgggctgcgcgtctcattttcagccttgcccggactctcccaaagccggcgcccagtagtggctccagagcccacaggtggcccccggcagtctctggggcgcatggagcggcgttaatagggctggcggcgcaggccagtagccgctccaacatgaacctcgtgggcagctacgcacaccatcaccaccatcaccacccgcaccctgcgcaccccatgctccacgaacccttcctcttcggtccggcctcgcgctgtcatcaggaaaggccctacttccagagctggctgctgagcccggctgacgctgccccggacttccctgcgggcgggccgccgcccgcggccgctgcagccgccaccgcctatggtcctgacgccaggcctgggcagagccccgggcggctggaggcgcttggcggccgtcttggccggcggaaaggctcaggacccaagaaggagcggagacgcactgagagcattaacagcgcattcgcggagttgcgcgagtgcatccccaacgtgccggccgacaccaagctctccaagatcaagactctgcgcctagccaccagctacatcgcctacctgatggacgtgctggccaaggatgcacagtctggcgatcccgaggccttcaaggctgaactcaagaaggcggatggcggccgtgagagcaagcggaaaagggagctgcagcagcacgaaggttttcctcctgccctgggcccagtcgagaagaggattaaaggacgcaccggctggccgcagcaagtctgggcgctggagttaaaccagtgagccgaggcccgcgccgaggacctggccaggccagccactcctgaagccccgggaggagaggaaggcagcggcgaacgccaggctctgggctccggcgactggtgctacgcatcccgcggagcttctgctgagcgccggcaggtcgtcggctgcaaccacacacttggatcgcacgtgcaatgtcctttgattttttttaatacattaagagaaagagaaatatatatatatccacccccagcccaaccgagggcggcccttggcggcaacatgcaagaaggagggactgtcgaacccaagggctcaaagacgcactcttccacccttttggagcgaatttagaacctcagccctatctccatttccctatctggctctttctctcttgtccctccatatgatccgccccgacgccgtcttctctaattaaaatgcaataaggaatcaattcttttctgcctgagaaagagaaccagacgcaggaagatgaaaggctgccctttgttcttcgaatcgtggtggttttattttatttttctttttgtcgctgcacttcctgtttagttccaagggaaacactttctctctttctctgtctctctcttttcttccttcttttccttcctttttgtttctatctaaataaaagctttccctgtgttggaaagtttttatgtatttaaactacctaccatgcctgttgtgctcaggtgtttgttcatcctgccatccccaacccttttctacctcaagtctgtgtgaccactcacagcccccctcccttcgccaaagcagtgtctatgctcttgattaataaaacattttctgaaatcaaaaaaaaaaaa

SEQ ID NO: 258 - protein, 216 aa, Homo sapiens
MNLVGSYAHHHHHHHPHPAHPMLHEPFLFGPASRCHQERPYFQSWLLSPADAAPDFPAGGPPPAAAAAATAYGPDARPGQSPGRLEALGGRLGRRKGSGPKKERRRTESINSAFAELRECIPNVPADTKLSKIKTLRLATSYIAYLMDVLAKDAQSGDPEAFKAELKKADGGRESKRKRESLQQHEGFPPALGPVEKRIKGRTGWPQQVWALELNQ

SEQ ID NO: 259 - DNA, 2368 bp, Homo sapiens
ctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccccccggcacagctggaccggctcctccagccgcggctcagactcgcccctggattccgggttagcttcggtgccaggaccgcggcccgggcttggattcccgagactccgcgtaccagcctcgcgggagccccggcacctttgtatgagcacgagaggattctgcctccgcgcagcagcccgggaagcaggagccgaagcgcgggccgtggagcaaggcgggaaccggaggcggcggcggcggcggccaggggcgcacggtgccaggaccagctcgccgcgccccatggggagccggcggccgcagcgctgctgaggcgggcccggctggccaggcggggggacggggcccgggctgcagcagccccctctgcggctgccgggcgggcccgggcgcccgggggctggggggtggggggtgggggaggacgccgagcgctgaggcaggggcccgggccgagggcgcggcggggctgcgcgcacgctggggcgcgtggaggggcgcggagggcgaaatgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatga

SEQ ID NO: 260 - protein, 217 aa, Homo sapiens
MSLVGGFPHHPVVHHEGYPFAAAAAAAAAAAASRCSHEENPYFHGWLIGHPEMSPPDYSMALSYSPEYASGAAGLDHSHYGGVPPGAGPPGLGGPRPVKRRGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 261 - DNA, 2729 bp, Homo sapiens
gaaggaagaggaagaggaggagagggaggccagagccagaacagcccggcagcccgagcttcgggggagaacggcctgagccccgagcaagttgcctcgggagccctaatcctctcccgctggctcgccgagcggtcagtggcgctcagcggcggcgaggctgaaatatgataatcagaacagctgcgccgcgcgccctgcagccaatgggcgcggcgctcgcctgacgtccccgcgcgctgcgtcagaccaatggcgatggagctgagttggagcagagaagtttgagtaagagataaggaagagaggtgcccgagccgcgccgagtctgccgccgccgcagcgcctccgctccgccaactccgccggcttaaattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatatgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagataaataaataaaaaaaaaaaaaa

SEQ ID NO: 262 - protein, 349 aa, Homo sapiens
MGDMGDPPKKKRLISLCVGCGNQIHDQYILRVSPDLEWHAACLKCAECNQYLDESCTCFVRDGKTYCKRDYIRLYGIKCAKCSIGFSKNDFVMRARSKVYHIECFRCVACSRQLIPGDEFALREDGLFCRADHDVVERASLGAGDPLSPLHPARPLQMAAEPISARQPALRPHVHKQPEKTTRVRTVLNEKQLHTLRTCYAANPRPDALMKEQLVEMTGLSPRVIRVWFQNKRCKDKKRSIMMKQLQQQQPNDKTNIQGMTGTPMVAASPERHDGGLQANPVEVQSYQPPWKVLSDFALQSDIDQPAFQQLVNFSEGGPGSNSTGSEVASMSSQLPDTPNSMVASPIEA

SEQ ID NO: 263 - DNA, 6055 bp, Homo sapiens
actgagtcccgggaccccgggagagcggtcaatgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcctggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaatccctttgcaaggttgcattactgtacccatcatttctaaaatggaagagggggtggctgggcacagtggccgacacctaaaaacccagcactttggggggccaaggtgggaggatcgcttgagcccaggagttcaagaccagtctggccaacatggtcagattccatctcaaagaaaaaaggtaaaaataaaataaaatggagaagaaggaatcaga

SEQ ID NO: 264 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 265 - protein, 678 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLGRETILDHCAEAVGMP

SEQ ID NO: 266 - protein, 712 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSE

SEQ ID NO: 267 - DNA, 1184 bp, Homo sapiens
tggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtggcgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatccccgcctgcctgccccggagcccgagctgcacccgagccgcgcgacccgcctgcgctgttcgccgaggcggcgtgccctgaagggcaggcgatggagccaagcccaccgtccccgctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtcagttggcaaaaaaaaaaaaaaaaaaaaaaaa

SEQ ID NO: 268 - protein, 268 aa, Homo sapiens
MAQPLCPPLSESWMLSAAWGPTRRPPPSDKDCGRSLVSSPDSWGSTPADSPVASPARPGTLRDPRAPSVGRRGARSSRLGSGQRQSASEREKLRMRTLARALHELRRFLPPSVAPAGQSLTKIETLRLAIRYIGHLSAVLGLSEESLQRRCRQRGDAGSPRGCPLCPDDCPAQMQTRTQAEGQGQGRGLGLVSAVRAGASWGSPPACPGARAAPEPRDPPALFAEAACPEGQAMEPSPPSPLLPGDVLALLETWMPLSPLEWLPEEPK

SEQ ID NO: 269 - DNA, 6950 bp, Homo sapiens
aatcgccggcagcctatgacatcagacaggaacgcctgggatgccgcgctgctcctggccaacctccgaggaggaggagggtcccgccggctaagagttaattagccccgcacggcgaggggggaggcgccagttttctggggacactggctgccactgtactcctacccaggggagctcacggagagttggatgaattctgggttgttagctgcggtcagctgggctcccgggagcctgttgctggtggagaacagggggcgcctggccaagggaccagcggcttgctgagactcaacatgacactcctggggtctgagcattccttgctgattaggagcaagttcagatcagttttacagttaagacttcaacaaagaaggacccaggaacaactggctaaccaaggcataataccaccactgaaacgtccagctgaattccatgagcaaagaaaacatttggatagtgacaaggctaaaaattccctgaagcgcaaagccagaaacaggtgcaacagtgccgacttggttaatatgcacatactccaagcttccactgcagagaggtccattccaactgctcagatgaagctgaaaagagcccgactcgccgatgatctcaatgaaaaaattgctctacgaccagggccactggagctggtggaaaaaaacattcttcctgtggattctgctgtgaaagaggccataaaaggtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccaggatcttgcttctggctcagaaaatgacagaaatgactcagcctcacagcccagccaccagtcagatgcggggaagcaggggcttggcccccccagcacccccatagccgtgcatgctgctgtaaagtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagaactcaggagcacacgatggccatcctccaagcttctctccccattcttccagcctccacccgcccttctctggagcccaagcagacagcagtcatggtgccgggggaaacccttgtcccaaaagcccatgtgtacagcaaaagatggctggtttacactcttctgataaggtggggccaaagttttcaattccatccccaactttttctaagtcaagttcagcaatttcagaggtaacacagcctccatcctatgaagatgccgtaaagcagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttctagcccataatttttctcaggcattgttggggcataagctcacactgtaagcttttctcatgaattcactagacataacgtggaaggaaaacgtagtcttttgggagtacagggaagccagcccctcaaagcttatggaagacatacctgcaatggaagctgttgcccaatgtctccattactatctttcaaaagagaagccagacccagcttcagatcaaaagttcttgagacagaggaacaaaaccaatcgatttccagggaagctaatcaactctcttttccctctaccacaaaactgccctgctggagtggttctgaacctgtacccaggactcgatgtggtcactaataacaattaacctgaactgagtccacagaactccactcggaactttcttcttttttaactagtggcccaatcattcccaccatctctgtgctgataagtacgtgtcctagatgagaaccctgaagaatgcagaccttcttcccccgaaggagatgccacaagctctccaacacagccccctttagttccaaagactagagatgaccacattggtagaagtatatctcgaggcacaggaagggagccccaccagggataattcagacaggactagagaataacatcatttcacataccctgggataaacaccctgggttcctatagaaggactattacttatgggagtccaacttctccttttgttttgttattatcagtttatctttctcccactccacttttccttcaaggtaccaatcctttcctgttcctcgtttggccatctttctttttctgcctccacattgggaggggaggacttctcagttctaacaagctgccatactcctaagaaagccatttttgaaaaatttaacaatccaggttcttctggagaactcattctccacacgcacagtttgctgcaaaaggaagttgcaagaatttcttgaggaagaaactggtgacttggtccatcagtcacgaagttctttctattctcgtttagttttcaagaaattattggtttgtgttgctctggggaaattggaaatcattacattgtaaagacaaatatggatgatatttacaagagagaatttcagatctgggtttttgaaagaaaacagaattgcgcattgaaaacgatggaaggaaaaagacaatggtctaatgtgcattcctcattacctctcgtggctttggctgggagttggaaaaagctaaaatttcagaacagtctctgtaaggctctctgtggctccagttcaccattttatattgttgcatgctgtagaaaggagctattgctgttgttttgtttttttatttaaatcactaaggcactgtttttatcttttgtaaaaaaaaaaaaaaagttgttcactgtgcacttatagaaaaaataatcaaaaatgttgggattttagaagctctctttttgataaaccaaagatttagaagtcattccattgttaacttgtaaaaatgtgtgaacacagagagtttttggtgattgctactctgaaagctgccagatcttattctgggggtgggatgtggaggaatacacatacacacacaaacatacatgtatgtataatagatatatacatatgtgtatattatatctgtgtgtgcatgtatctccaaaagcggcgttacagagttctacaccaaaagcctttaacccttaatctgctgtgaatgatacctggcctttctcactatgaatttctgattaaccaaccagactacacgttgcctctctgtgtatgactaacggctccaacccgatgactcacagctacttgcttatcgtgaacaagctcatcttggcaatgaatatggatgtgaaaagacagaacagcttcaccattagtagctggaaatggtatcacagtctcttatagaggaatatgaaaggaacaagaaaatcattttacattccttttatctgtattgtgctttaaaagatccacatggtaaattttttattttgcttttatgtcagtcatcagaaccaaaaaaatccagaagaaaaaattgccagtgtttcctttgaagatgaagctactggggaagaaaaccttattaatacactccacacatttgttcattcctcagctgttggtgttttcttggggtcttgacaaagcttgctggtcagtgcacttttcaggtgtcacgttttgctgtttgtatgttttttcttccccttacttcctttggaaaacaaactcacacagtgcccctactctgagacctgggactgagtgttaattattttttccttgggtatttctatctgagagactagacctagttaggaggcctctgtacttctccagattgtacctttttatggggatctttgaggctatgacccaggactgatagatatgccttacggaagacaaaagataaaatggttcctatatcctaatgcaaaccaacacagttaaaagagcagatctctggataactgctctcaacctgcttctacagtctccacaaaccgcattcaccctctctcttcatagctcagacatgaaatttgagggagaaaactggagataattgggagaaaattgatgaagttggctgcttccagtagatcagataatccatgaatttgtctcccattgagaattttattttaaattcttttaaactcttcgttgtgtcttttgtgatgacaaatcaggcatgactaaaagatgtacagagacttacgaagatggtcacattcaagttccctaatgctcttagaacctgaagatgaccatgtgtagttttcttaagacctctgaacccccatggtgatgaagacttgaagacatttgcagctatctgctgcagtctggtagattcatacttatctaaagaagtcaaaaaatttattcgtgcaagtgcttgcaggaagccagtgcttattagtagtgaccctgcttctatcaacgttattgagacaacacatattctattctaagggagaaagagggaggaagagagggagggagggaggaagaagagggagggagcgaggaaggaagataggagatgggtaggggggtaaagagaaaaggagggagaagggaaggaaggaaagaagagaggaaagaaaggagggaaggaaaaaagggccaaactttctgatctatgaacttctcagttcagctgtcacattatgagaagtaaatcagaatttttttaaggagaagtcattcttagcactacaataattgtaccagtaattgaggaaaccaagacaatcttcacctgaataatagagggtctgagaactgtcagccttttgccattcaaaaacatttatgtccaacctgaaaaaaaagcatcaataaaacctatcccaagcattc

SEQ ID NO: 270 - protein, 648 aa, Homo sapiens
FLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQNSGAHDGHPPSFSPHSSSLHPPFSGAQADSSHGAGGNPCPKSPCVQQKQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 271 - DNA, 6806 bp, Homo sapiens
aatcgccggcagcctatgacatcagacaggaacgcctgggatgccgcgctgctcctggccaacctccgaggaggaggagggtcccgccggctaagagttaattagccccgcacggcgaggggggaggcgccagttttctggggacactggctgccactgtactcctacccaggggagctcacggagagttggatgaattctgggttgttagctgcggtcagctgggctcccgggagcctgttgctggtggagaacagggggcgcctggccaagggaccagcggcttgctgagactcaacatgacactcctggggtctgagcattccttgctgattaggagcaagttcagatcagttttacagttaagacttcaacaaagaaggacccaggaacaactggctaaccaaggcataataccaccactgaaacgtccagctgaattccatgagcaaagaaaacatttggatagtgacaaggctaaaaattccctgaagcgcaaagccagaaacaggtgcaacagtgccgacttggttaatatgcacatactccaagcttccactgcagagaggtccattccaactgctcagatgaagctgaaaagagcccgactcgccgatgatctcaatgaaaaaattgctctacgaccagggccactggagctggtggaaaaaaacattcttcctgtggattctgctgtgaaagaggccataaaaggtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccaggatcttgcttctggctcagaaaatgacagaaatgactcagcctcacagcccagccaccagtcagatgcggggaagcaggggcttggcccccccagcacccccatagccgtgcatgctgctgtaaagtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagatggctggtttacactcttctgataaggtggggccaaagttttcaattccatccccaactttttctaagtcaagttcagcaatttcagaggtaacacagcctccatcctatgaagatgccgtaaagcagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttctagcccataatttttctcaggcattgttggggcataagctcacactgtaagcttttctcatgaattcactagacataacgtggaaggaaaacgtagtcttttgggagtacagggaagccagcccctcaaagcttatggaagacatacctgcaatggaagctgttgcccaatgtctccattactatctttcaaaagagaagccagacccagcttcagatcaaaagttcttgagacagaggaacaaaaccaatcgatttccagggaagctaatcaactctcttttccctctaccacaaaactgccctgctggagtggttctgaacctgtacccaggactcgatgtggtcactaataacaattaacctgaactgagtccacagaactccactcggaactttcttcttttttaactagtggcccaatcattcccaccatctctgtgctgataagtacgtgtcctagatgagaaccctgaagaatgcagaccttcttcccccgaaggagatgccacaagctctccaacacagccccctttagttccaaagactagagatgaccacattggtagaagtatatctcgaggcacaggaagggagccccaccagggataattcagacaggactagagaataacatcatttcacataccctgggataaacaccctgggttcctatagaaggactattacttatgggagtccaacttctccttttgttttgttattatcagtttatctttctcccactccacttttccttcaaggtaccaatcctttcctgttcctcgtttggccatctttctttttctgcctccacattgggaggggaggacttctcagttctaacaagctgccatactcctaagaaagccatttttgaaaaatttaacaatccaggttcttctggagaactcattctccacacgcacagtttgctgcaaaaggaagttgcaagaatttcttgaggaagaaactggtgacttggtccatcagtcacgaagttctttctattctcgtttagttttcaagaaattattggtttgtgttgctctggggaaattggaaatcattacattgtaaagacaaatatggatgatatttacaagagagaatttcagatctgggtttttgaaagaaaacagaattgcgcattgaaaacgatggaaggaaaaagacaatggtctaatgtgcattcctcattacctctcgtggctttggctgggagttggaaaaagctaaaatttcagaacagtctctgtaaggctctctgtggctccagttcaccattttatattgttgcatgctgtagaaaggagctattgctgttgttttgtttttttatttaaatcactaaggcactgtttttatcttttgtaaaaaaaaaaaaaaagttgttcactgtgcacttatagaaaaaataatcaaaaatgttgggattttagaagctctctttttgataaaccaaagatttagaagtcattccattgttaacttgtaaaaatgtgtgaacacagagagtttttggtgattgctactctgaaagctgccagatcttattctgggggtgggatgtggaggaatacacatacacacacaaacatacatgtatgtataatagatatatacatatgtgtatattatatctgtgtgtgcatgtatctccaaaagcggcgttacagagttctacaccaaaagcctttaacccttaatctgctgtgaatgatacctggcctttctcactatgaatttctgattaaccaaccagactacacgttgcctctctgtgtatgactaacggctccaacccgatgactcacagctacttgcttatcgtgaacaagctcatcttggcaatgaatatggatgtgaaaagacagaacagcttcaccattagtagctggaaatggtatcacagtctcttatagaggaatatgaaaggaacaagaaaatcattttacattccttttatctgtattgtgctttaaaagatccacatggtaaattttttattttgcttttatgtcagtcatcagaaccaaaaaaatccagaagaaaaaattgccagtgtttcctttgaagatgaagctactggggaagaaaaccttattaatacactccacacatttgttcattcctcagctgttggtgttttcttggggtcttgacaaagcttgctggtcagtgcacttttcaggtgtcacgttttgctgtttgtatgttttttcttccccttacttcctttggaaaacaaactcacacagtgcccctactctgagacctgggactgagtgttaattattttttccttgggtatttctatctgagagactagacctagttaggaggcctctgtacttctccagattgtacctttttatggggatctttgaggctatgacccaggactgatagatatgccttacggaagacaaaagataaaatggttcctatatcctaatgcaaaccaacacagttaaaagagcagatctctggataactgctctcaacctgcttctacagtctccacaaaccgcattcaccctctctcttcatagctcagacatgaaatttgagggagaaaactggagataattgggagaaaattgatgaagttggctgcttccagtagatcagataatccatgaatttgtctcccattgagaattttattttaaattcttttaaactcttcgttgtgtcttttgtgatgacaaatcaggcatgactaaaagatgtacagagacttacgaagatggtcacattcaagttccctaatgctcttagaacctgaagatgaccatgtgtagttttcttaagacctctgaacccccatggtgatgaagacttgaagacatttgcagctatctgctgcagtctggtagattcatacttatctaaagaagtcaaaaaatttattcgtgcaagtgcttgcaggaagccagtgcttattagtagtgaccctgcttctatcaacgttattgagacaacacatattctattctaagggagaaagagggaggaagagagggagggagggaggaagaagagggagggagcgaggaaggaagataggagatgggtaggggggtaaagagaaaaggagggagaagggaaggaaggaaagaagagaggaaagaaaggagggaaggaaaaaagggccaaactttctgatctatgaacttctcagttcagctgtcacattatgagaagtaaatcagaatttttttaaggagaagtcattcttagcactacaataattgtaccagtaattgaggaaaccaagacaatcttcacctgaataatagagggtctgagaactgtcagccttttgccattcaaaaacatttatgtccaacctgaaaaaaaagcatcaataaaacctatcccaagcattc

SEQ ID NO: 272 - protein, 684 aa, Homo sapiens
MKLKRARLADDLNEKIALRPGPLELVEKNILPVDSAVKEAIKGNQVSFSKSTDAFAFEEDSSSDGLSPDQTRSEDPQNSAGSPPDAKASDTPSTGSLGTNQDLASGSENDRNDSASQPSHQSDAGKQGLGPPSTPIAVHAAVKSKSLGDSKNRHKKPKDPKPKVKKLKYHQYIPPDQKAEKSPPPMDSAYARLLQQQQLFLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQNSGAHDGHPPSFSPHSSSLHPPFSGAQADSSHGAGGNPCPKSPCVQQKMAGLHSSDKVGPKFSIPSPTFSKSSSAISEVTQPPSYEDAVKQVTM

SEQ ID NO: 273 - protein, 324 aa, Homo sapiens
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKELCALQKAVELEKTEADNAERPRARRRRKPRVLFSQAQVYELERRFKQQRYLSAPERDQLASVLKLTSTQVKIWFQNRRYKCKRQRQDQTLELVGLPPPPPPPARRIAVPVLVRDGKPCLGDSAPYAPAYGVGLNPYGYNAYPAYPGYGGAACSPGYSCTAAYPAGPSPAQPATAAANNNFVNFGVGDLNAVQSPGIPQSNSGVSTLHGIRAW

SEQ ID NO: 274 - DNA, 1961 bp, Homo sapiens
gctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagcctgaaattttaagtcaccgtctgtctccctcaccagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaccccg

SEQ ID NO: 275 - protein, 151 aa, Homo sapiens
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKGCELPRGQRPPVLFSSALSQPDFLQMLSETCRWLPVHLAE

SEQ ID NO: 276 - DNA, 1924 bp, Homo sapiens
gctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaccccg

SEQ ID NO: 277 - protein, 112 aa, Homo sapiens
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKA

SEQ ID NO: 278 - DNA, 3921 bp, Homo sapiens
catgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 279 - protein, 518 aa, Homo sapiens
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 280 - DNA, 3749 bp, Homo sapiens
ttcagagagagagagagagggagagagagtgagagagactgactcttacctcgaatccgggaactttaatcctgaaagctgcgctcagaaaggacttcgaccattcactgggcttccaactttccctccctgggggtgtaaaggaggagcggggcactgagattatatggttgccggtgctcttggaggctattttgtgttctttggcgcttgccaactgggaagtatttagggagagcaagcgcacagcagaggaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 281 - DNA, 3828 bp, Homo sapiens
tagttggataggcgatttcagtactttgtgagcatcgaggcaacccaacgtcactgtgctcagctgagttggcttgtatttcagagagagagagagagggagagagagtgagagagactgactcttacctcgaatccgggaactttaatcctgaaagctgcgctcagaaaggacttcgaccattcactgggcttccaactttccctccctgggggtgtaaaggaggagcggggcactgagattatatggttgccggtgctcttggaggctattttgtgttctttggcgcttgccaactgggaagtatttagggagagcaagcgcacagcagaggaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 282 - DNA, 3736 bp, Homo sapiens
catgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 283 - protein, 468 aa, Homo sapiens
MEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 284 - DNA, 1062 bp, Homo sapiens
atggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccatcaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggaggtggggcgcctggccaaagagcgggacctgtacaaggagaaatacgagaagctggcgggccggggcggccccgggagcgcgggcggggccggtttcccgcgggagccttcgccgccgcaggccggtcccggcggggccaagggcacggccgacttcttcctgtag

SEQ ID NO: 285 - protein, 353 aa, Homo sapiens
MAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEVGRLAKERDLYKEKYEKLAGRGGPGSAGGAGFPREPSPPQAGPGGAKGTADFFL

SEQ ID NO: 286 - DNA, 1683 bp, Homo sapiens
cgcgctctctcgctctcagggcccccctcgctcccccggccgcagtccgtgcgcgagggcgccggcgagccgtctcggaagcagcatgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccggacgcgcgggcctggtggtgccgccgctggcgctgccctacgccgccgcgccgcccgccgcctacggccagccgtgcgctcagggcctggaggccggggccgccgggggctaccagtgcagcatgcgagcgatgagcctgtacaccggggccgagcggccggcgcacatgtgcgtcccgcccgccctggacgaggccctctcggaccacccgagcggccccacgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccgacccaaccagacaattaaggggctgcagagacgcaaaa

SEQ ID NO: 287 - DNA, 1255 bp, Homo sapiens
gataaagcgtgccaaggggcacacgacttgctgctcaggaaatccctgcggtctcaccgccgcgcctcgagagagagcgtgacagaggcctcggaccccattctctcttcttttctcctttggggctggggcaactcccaggcgggggcgcctgcagctcagctgaacttggcgaccagaagcccgctgagctccccacggccctcgctgctcatcgctctctattcttttgcgccggtagaaaggatgacgcctcaaccctcgggtgcgcccactgtccaagtgacccgtgagacggagcggtccttccccagagcctcggaagacgaagtgacctgccccacgtccgccccgcccagccccactcgcacacgggggaactgcgcagaggcggaagagggaggctgccgaggggccccgaggaagctccgggcacggcgcgggggacgcagccggcctaagagcgagttggcactgagcaagcagcgacggagtcggcgaaagaaggccaacgaccgcgagcgcaatcgaatgcacaacctcaactcggcactggacgccctgcgcggtgtcctgcccaccttcccagacgacgcgaagctcaccaagatcgagacgctgcgcttcgcccacaactacatctgggcgctgactcaaacgctgcgcatagcggaccacagcttgtacgcgctggagccgccggcgccgcactgcggggagctgggcagcccaggcggttcccccggggactgggggtccctctactccccagtctcccaggctggcagcctgagtcccgccgcgtcgctggaggagcgacccgggctgctgggggccaccttttccgcctgcttgagcccaggcagtctggctttctcagattttctgtgaaaggacctgtctgtcgctgggctgtgggtgctaagggtaagggagagggagggagccgggagccgtagagggtggccgacggcggcggccctcaaaagcacttgttccttctgcttctccctggctgacccctggccggcccaggcctccacgggggcggcaggctgggttcattccccggccctccgagccgcgccaacgcacgcaacccttgctgctgcccgcgcgaagtgggcattgcaaagtgcgctcattttaggcctcctctctgccaccaccccataatctcattcaaagaatactagaatggtagcactacccggccggagccgcccaccgtcttgggtcgccctaccctcactca

SEQ ID NO: 288 - protein, 214 aa, Homo sapiens
MTPQPSGAPTVQVTRETERSFPRASEDEVTCPTSAPPSPTRTRGNCAEAEEGGCRGAPRKLRARRGGRSRPKSELALSKQRRSRRKKANDRERNRMHNLNSALDALRGVLPTFPDDAKLTKIETLRFAHNYIWALTQTLRIADHSLYALEPPAPHCGELGSPGGSPGDWGSLYSPVSQAGSLSPAASLEERPGLLGATFSACLSPGSLAFSDFL

SEQ ID NO: 289 - DNA, 2010 bp, Homo sapiens
caaagactcacccgtgagccagctctcaaagaaagcagcttgcgttgacagcctgggggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggccacttgcccccacagccgaattccctggactcaggactgctttgccttccttgcccttcctcccactgtcacctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacgttgcctggccctgcctcgatgcctctctggcgcatcacctgattggaggggctggtaaagcaacacccacccacttctcacactagccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgcgtgcatgcgtgcgcgcacacacacacacacacacacacactgacattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattct

SEQ ID NO: 290 - protein, 350 aa, Homo sapiens
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSHWP

SEQ ID NO: 291 - protein, 273 aa, Homo sapiens
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPAVPWQCAHSSPACPGTTGSLLLSAVLGNSTRKVSE

SEQ ID NO: 292 - protein, 343 aa, Homo sapiens
MNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCHLASLSGSQALLWPGCPLLYGLE

SEQ ID NO: 293 - DNA, 2573 bp, Homo sapiens
gggtggcgccgggagtgggaacgccacacagtgccaaatccccggctccagctcccgactcccggctcccggctcccggctcccggtgcccaatcccgggccgcagccatgaacggcgaggagcagtactacgcggccacgcagctttacaaggacccatgcgcgttccagcgaggcccggcgccggagttcagcgccagcccccctgcgtgcctgtacatgggccgccagcccccgccgccgccgccgcacccgttccctggcgccctgggcgcgctggagcagggcagccccccggacatctccccgtacgaggtgccccccctcgccgacgaccccgcggtggcgcaccttcaccaccacctcccggctcagctcgcgctcccccacccgcccgccgggcccttcccggagggagccgagccgggcgtcctggaggagcccaaccgcgtccagctgcctttcccatggatgaagtctaccaaagctcacgcgtggaaaggccagtgggcaggcggcgcctacgctgcggagccggaggagaacaagcggacgcgcacggcctacacgcgcgcacagctgctagagctggagaaggagttcctattcaacaagtacatctcacggccgcgccgggtggagctggctgtcatgttgaacttgaccgagagacacatcaagatctggttccaaaaccgccgcatgaagtggaaaaaggaggaggacaagaagcgcggcggcgggacagctgtcgggggtggcggggtcgcggagcctgagcaggactgcgccgtgacctccggcgaggagcttctggcgctgccgccgccgccgccccccggaggtgctgtgccgcccgctgcccccgttgccgcccgagagggccgcctgccgcctggccttagcgcgtcgccacagccctccagcgtcgcgcctcggcggccgcaggaaccacgatgagaggcaggagctgctcctggctgaggggcttcaaccactcgccgaggaggagcagagggcctaggaggaccccgggcgtggaccacccgccctggcagttgaatggggcggcaattgcggggcccaccttagaccgaaggggaaaacccgctctctcaggcgcatgtgccagttggggccccgcgggtagatgccggcaggccttccggaagaaaaagagccattggtttttgtagtattggggccctcttttagtgatactggattggcgttgtttgtggctgttgcgcacatccctgccctcctacagcactccaccttgggacctgtttagagaagccggctcttcaaagacaatggaaactgtaccatacacattggaaggctccctaacacacacagcggggaagctgggccgagtaccttaatctgccataaagccattcttactcgggcgacccctttaagtttagaaataattgaaaggaaatgtttgagttttcaaagatcccgtgaaattgatgccagtggaatacagtgagtcctcctcttcctcctcctcctcttccccctccccttcctcctcctcctcttcttttccctcctcttcctcttcctcctgctctcctttcctccccctcctcttttccctcctcttcctcttcctcctgctctcctttcctccccctcctctttctcctcctcctcctcttcttccccctcctctccctcctcctcttcttccccctcctctccctcctcctcttcttctccctcctcttcctcttcctcctcttccacgtgctctcctttcctccccctcctcttgctccccttcttccccgtcctcttcctcctcctcctcttcttctccctcctcttcctcctcctctttcttcctgacctctttctttctcctcctcctccttctacctccccttctcatccctcctcttcctcttctctagctgcacacttcactactgcacatcttataacttgcacccctttcttctgaggaagagaacatcttgcaaggcagggcgagcagcggcagggctggcttaggagcagtgcaagagtccctgtgctccagttccacactgctggcagggaaggcaaggggggacgggcctggatctgggggtgagggagaaagatggacccctgggtgaccactaaaccaaagatattcggaactttctatttaggatgtggacgtaattcctgttccgaggtagaggctgtgctgaagacaagcacagtggcctggtgcgccttggaaaccaacaactattcacgagccagtatgaccttcacatctttagaaattatgaaaacgtatgtgattggagggtttggaaaaccagttatcttatttaacattttaaaaattacctaacagttatttacaaacaggtctgtgcatcccaggtctgtcttcttttcaaggtctgggccttgtgctcgggttatgtttgtgggaaatgcttaataaatactgataatatgggaagagatgaaaactgattctcctcactttgtttcaaacctttctggcagtgggatgattcgaattcacttttaaaattaaattagcgtgttttgttttg

SEQ ID NO: 294 - protein, 283 aa, Homo sapiens
MNGEEQYYAATQLYKDPCAFQRGPAPEFSASPPACLYMGRQPPPPPPHPFPGALGALEQGSPPDISPYEVPPLADDPAVAHLHHHLPAQLALPHPPAGPFPEGAEPGVLEEPNRVQLPFPWMKSTKAHAWKGQWAGGAYAAEPEENKRTRTAYTRAQLLELEKEFLFNKYISRPRRVELAVMLNLTERHIKIWFQNRRMKWKKEEDKKRGGGTAVGGGGVAEPEQDCAVTSGEELLALPPPPPPGGAVPPAAPVAAREGRLPPGLSASPQPSSVAPRRPQEPR

SEQ ID NO: 295 - DNA, 3452 bp, Homo sapiens
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttgacacaccctcaaagccgaactaaatcgaaccccaaagcaggaaaagctaaaggaacccatcaaggcaaaatcgaaactaaaaaaaaaaaatccaattaaaaaaaacccctgagaatattcaccacaccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgcagtgcatattatacatccctgtgagccagatgctgaatagatattttcctattatttcagtcctttataaaaggaaaaataaaccagtttttaaatgtatgtatataattctcccccatttacaatccttcatgtattacatagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagtcaaaaa

SEQ ID NO: 296 - protein, 553 aa, Homo sapiens
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGSFLRRRRRFKKKDAVKDKEEKDRLHLKEPPPPGRQPPPAPPEQADGNAPGPQPPPVRIQDIKTENGTCPSPPQPLSPAAALGSGSAAAVPKIESPDSSSSSLSSGSSPPGSLPSARPLSLDGADSAPPPPAPSAPPPHHSQGFSVDNIMTSLRGSPQSAAAELSSGLLASAAASSRAGIAPPLALGAYSPGQSSLYSSPCSQTSSAGSSGGGGGGAGAAGGAGGAGTYHCNLQAMSLYAAGERGGHLQGAPGGAGGSAVDDPLPDYSLPPVTSSSSSSLSHGGGGGGGGGGQEAGHHPAAHQGRLTSWYLNQAGGDLGHLASAAAAAAAAGYPGQQQNFHSVREMFESQRIGLNNSPVNGNSSCQMAFPSSQSLYRTSGAFVYDCSKF

SEQ ID NO: 297 - protein, 501 aa, Homo sapiens
MQARYSVSDPNALGVVPYLSEQNYYRAAGSYGGMASPMGVYSGHPEQYSAGMGRSYAPYHHHQPAAPKDLVKPPYSYIALITMAIQNAPEKKITLNGIYQFIMDRFPFYRENKQGWQNSIRHNLSLNECFVKVPRDDKKPGKGSYWTLDPDSYNMFENGSFLRRRRRFKKKDVSKEKEERAHLKEPPPAASKGAPATPHLADAPKEAEKKVVIKSEAASPALPVITKVETLSPESALQGSPRSAASTPAGSPDGSLPEHHAAAPNGLPGFSVENIMTLRTSPPGGELSPGAGRAGLVVPPLALPYAAAPPAAYGQPCAQGLEAGAAGGYQCSMRAMSLYTGAERPAHMCVPPALDEALSDHPSGPTSPLSALNLAAGQEGALAATGHHHQHHGHHHPQAPPPPPAPQPQPTPQPGAAAAQAASWYLNHSGDLNHLPGHTFAAQQQTFPNVREMFNSHRLGIENSTLGESQVSGNASCQLPYRSTPPLYRHAAPYSYDCTKY

SEQ ID NO: 298 - DNA, 6449 bp, Homo sapiens
gagctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgaaaaaaaaaaa

SEQ ID NO: 299 - DNA, 6446 bp, Homo sapiens
gagctgttctccttttcccattcgtcttctgtcacttccttcctggacgcagttttctggacgagtctggttacttttaatccgaccggccgctgagagccactttctcctcctcctcctcctcctccttctcttcctcctccttcttcctcctcctcctcctcttccgagcggcctcggcgcgcgcgaatgcgcggccccgcgccccccccctcgcgcgcgctcccctcgcgcgcgcgcacacacgcacacatcgtctccagctctctgctcgctctgctcgcagtcacagacacttgagcacacgcgtacacccagacatcttcgggctgctattggattgactttgaaggttctgtgtgggtcgccgtggctgcatgtttgaatcaggtggagaagcacttcaacgctggacgaagtaaagattattgttgttattttttttttctctctctctctctcttaagaaaggaaaatatcccaaggactaatctgatcgggtcttccttcatgaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgaaaaaaaaaaa

SEQ ID NO: 300 - protein, 473 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 301 - DNA, 6194 bp, Homo sapiens
aagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgaaaaaaaaaaa

SEQ ID NO: 302 - protein, 465 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 303 - DNA, 6254 bp, Homo sapiens
aagggggcaaagcctcggtcttcatagaaaaggagaggaggcaaacgcagcccaaactggggggtttctcttcaaagccagctggtctggctttattctgcaggaatttttttacctgtcagggtttggacaacaaagccctcagcaggtgctgacgggtacaacttcctggagaagcagaaaggcactggtgccaaagaagagttgcaaactgtgaagtaacttctatgaagagatgaagtaaagaacggaaggcaaatgattgtggcagtaaagaagtgtatgtgcaggaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgcattgaacaagaaagaaaacaaaggctgtgaaagccccgatcccgactcctcttatgcactcaccccacgcactgaagaaaaatacaaaaaaattaatgaagaatttgataatatgatcaagagtcataaaattcctgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgaaaaaaaaaaa

SEQ ID NO: 304 - protein, 441 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 305 - DNA, 5766 bp, Homo sapiens
gaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgaaaaaaaaaaa

SEQ ID NO: 306 - protein, 417 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVEAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 307 - DNA, 5694 bp, Homo sapiens
gaacgaatgcaggaatttgggaactgagctgtgcaagtgctgaagaaggagatttgtttggaggaaacaggaaagagaaagaaaaggaaggaaaaaatacataatttcagggacgagagagagaagaaaaacggggactatggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggaggctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaacatgatcagattattacttactagtttttttttttttcttgcagtgtgtgtgtgtgctataccttaatggggaaggggggtcgatatgcattatatgtgccgtgtgtggaaaaaaaaaaagtcaggtactctgttttgtaaaagtacttttaaattgcctcagtgatacagtataaagataaacagaaatgctgagataagcttagcacttgagttgtacaacagaacacttgtacaaaatagattttaaggctaacttcttttcactgttgtgctcctttgcaaaatgtatgttacaatagatagtgtcatgttgcaggttcaacgttatttacatgtaaatagacaaaaggaaacatttgccaaaagcggcagatctttactgaaagagagagcagctgttatgcaacatatagaaaaatgtatagatgcttggacagacccggtaatgggtggccattggtaaatgttaggaacacaccaggtcacctgacatcccaagaatgctcacaaacctgcaggcatatcattggcgtatggcactcattaaaaaggatcagagaccattaaaagaggaccatacctattaaaaaaaaatgtggagttggagggctaacatatttaattaaataaataaataaatctgggtctgcatctcttattaaataaaaatataaaaatatgtacattacattttgcttattttcatataaaaggtaagacagagtttgcaaagcatttgtggctttttgtagtttacttaagccaaaatgtgtttttttccccttgatagcttcgctaatattttaaacagtcctgtaaaaaaccaaaaaggactttttgtatagaaagcactaccctaagccatgaagaactccatgctttgctaaccaagataactgttttctctttgtagaagttttgtttttgaaatgtgtatttctaattatataaaatattaagaatcttttaaaaaaatctgtgaaattaacatgcttgtgtatagctttctaatatatataatattatggtaatagcagaagttttgttatcttaatagcgggaggggggtatatttgtgcagttgcacatttgagtaactattttctttctgttttcttttactctgcttacattttataagtttaaggtcagctgtcaaaaggataacctgtggggttagaacatatcacattgcaacaccctaaattgtttttaatacattagcaatctattgggtcaactgacatccattgtatatactagtttctttcatgctatttttattttgttttttgcatttttatcaaatgcagggcccctttctgatctcaccatttcaccatgcatcttggaattcagtaagtgcatatcctaacttgcccatattctaaatcatctggttggttttcagcctagaatttgatacgctttttagaaatatgcccagaatagaaaagctatgttggggcacatgtcctgcaaatatggccctagaaacaagtgatatggaatttacttggtgaataagttataaattcccacagaagaaaaatgtgaaagactgggtgctagacaagaaggaagcaggtaaagggatagttgctttgtcatccgtttttaattattttaactgacccttgacaatcttgtcagcaatataggactgttgaacaatcccggtgtgtcaggacccccaaatgtcacttctgcataaagcatgtatgtcatctattttttcttcaataaagagatttaatagccatttcaagaaatcccataaagaacctctctatgtccctttttttaatttaaaaaaaatgactcttgtctaatattcgtctataagggattaattttcagaccctttaataagtgagtgccataagaaagtcaatatatattgtttaaaagatatttcagtctaggaaagattttccttctcttggaatgtgaagatctgtcgattcatctccaatcatatgcattgacatacacagcaaagaagatataggcagtaatatcaacactgctatatcatgtgtaggacatttcttatccattttttctcttttacttgcatagttgctatgtgtttctcattgtaaaaggctgccgctgggtggcagaagccaagagaccttattaactaggctatatttttcttaacttgatctgaaatccacaattagaccacaatgcacctttggttgtatccataaaggatgctagcctgccttgtactaatgttttatatattaaaaaaaaaaaatctatcaaccatttcatatatatcccactactcaaggtatccatggaacatgaaagaataacatttatgcagaggaaaaacaaaaacatccctgaaaatatacacactcatacacacacacgcacaggggaataaaataagaaaatcattttcctcaccatagacttgatcccatccttacaacccatccttctaacttgatgtgtataaaatatgcaaacatttcacaaatgttctttgtcatttcaaaatactttagtatatcaatatcagtagataccagtgggtgggaaagggtcattacatgaaaatatgaagaaatagccatattagttttttaacctgcaatttgcctcagcaacaaagaaaaagtgaatttttaatgctgaagataaagtaagctaaagtaccagcagaagccttggctatttatagcagttctgacaatagttttataagaacatgaagagaacagaatcacttgaaaatggatgccagtcatctcttgttcccactactgaattcttataaagtggtggcaagatagggaagggataatctgagaatttttaaaagatgatttaatgagaagaagcacaattttgattttgatgagtcactttctgtaaacaatcttggtctatctttacccttataccttatctgtaatttaccatttattgtatttgcaaagctagtatggtttttaatcacagtaaatcctttgtattccagactttagggcagagccctgagggagtattattttacataacccgtcctagagtaacattttaggcaacattcttcattgcaagtaaaagatccataagtggcattttacacggctgcgagtattgttatatctaatcctattttaaaagatttttggtaatatgaagcttgaatactggtaacagtgatgcaatatacgcaagctgcacaacctgtatattgtatgcattgctgcgtggaggctgtttatttcaacctttttaaaaattgtgttttttagtaaaatggcttattttttcccaaaggtggaatttagcattttgtaatgatgaatataaaaatacctgtcatccccagatcatttaaaagttaactaaagtgagaatgaaaaaacaaaattccaagacactttttaaaagaatgtctgccctcacacacttttatggatttgtttttcttacatacccatcttttaacttagagatagcattttttgccctctttattttgttgtttgtttctccagagagtaaacgctttgtagttctttctttaaaaaacattttttttaaagaagaagaagccacttgaaccctcaataaaggctgttgcctaagcatggcatacttcatctgttctcatttgtgccatctgccgtgatgtcgtcacttttatggcgttaatttcctgccactacagatcttttgaagattgctggaatactggtgtctgttagaatgcttcagactacagatgtaattaaaggcttttcttaatatgttttaaccaaagatgtggagcaatccaagccacatatcttctacatcaaatttttccattttggttattttcataatctggtattgcattttgccttccctgttcatacctcaaattgattcatacctcagtttaattcagagaggtcagttaagtgacggattctgttgtggtttgaatgcagtaccagtgttctcttcgagcaaagtagacctgggtcactgtaggcataggacttggattgcttcagatggtttgctgtatcatttttcttctttttcttttcctggggacttgtttccattaaatgagagtaattaaaatcgcttgtaaatgagggcatacaagcatttgcaacaaatattcaaatagaggctcacagcggcataagctggactttgtcgccactagatgacaagatgttataactaagttaaaccacatctgtgtatctcaagggacttaattcagctgtctgtagtgaataaaagtgggaaattttcaaaagtttctcctgctggaaataaggtataatttgtattttgcagacaattcagtaaagttactggctttcttagtgaaaaaaaaaaa

SEQ ID NO: 308 - protein, 483 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 309 - protein, 463 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 310 - DNA, 2032 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtaagccttggactttttagggggcaatttctcctggaagggagataaactcaactcttccttaagaaaggtgaattagaggcaagattaagccacacatgccggtatcaatttttttttttttttgcaaagccagctgactgttccagcaggggcttccttgtgtaattattttcttaactgatgtcaacaacatcttgcggttattaattgttgagacgtgaaacctga

SEQ ID NO: 311 - protein, 479 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 312 - DNA, 1504 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggtaagcggtggcgccttgggcggcgcacttgctgggtgacttggagggcatcggctagctgacattggtgatctgacggcagccaagcccagctcggatcaaggtcccttcatgcgcggtgtctctgcgcctgagtaacgacatggaactgaaagaccagagggacactaggaatcaaaacaaacatttctattctgcttagtttttctgttttgtaaatctttctttcttaaccactttcagcccctgggattctagaactgtgaattgtgctctgttgtagggggcaggggaagctctcactctgttgccattaaatgtatgagactgggcatctctgagcaattgtagggccggggatagagggtacttgaatcttcagaagttgaagtagcttttatgccctcaggaaaggccctggtctccggagtttcctcgcattaaaggagagagagagagagtactcttttgggcaacggccctccaaaattgcccccacattggctgccttataaatatgtctgtgtgttgactggt

SEQ ID NO: 313 - protein, 215 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKRWRLGRRTCWVTWRASAS

SEQ ID NO: 314 - DNA, 1095 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggaaaggccctggtctccggagtttcctcgcattaaaggagagagagagagagtactcttttgggcaacggccctccaaaattgcccccacattggctgccttataaatatgtctgtgtgttgactggt

SEQ ID NO: 315 - protein, 206 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKALVSGVSSH

SEQ ID NO: 316 - DNA, 3359 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaacttgaa

SEQ ID NO: 317 - DNA, 3128 bp, Homo sapiens
cggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaacttgaa

SEQ ID NO: 318 - protein, 505 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIAWFQILLNTFDKSSGEEEDLEQ

SEQ ID NO: 319 - DNA, 3112 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaacttgaa

SEQ ID NO: 320 - protein, 403 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISRK

SEQ ID NO: 321 - DNA, 2941 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtgcctttcattatctcaagccagatatcgcttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaacttgaa

SEQ ID NO: 322 - protein, 407 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISLGFKSF

SEQ ID NO: 323 - DNA, 3356 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaacttgaa

SEQ ID NO: 324 - protein, 483 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 325 - protein, 484 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 326 - DNA, 2271 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacaacacaaatatcaaaaaaaaaaaa

SEQ ID NO: 327 - protein, 520 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 328 - DNA, 2265 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacaacacaaatatcaaaaaaaaaaaa

SEQ ID NO: 329 - protein, 518 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 330 - DNA, 6053 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagactgctgttgattatctggccaaaaatgtgagcctctccacccagcgtcgcatgaagctcggggagcactctgctgtgctgggactcctgcctgtggaaactggccaggcctactagggcccctggggcgacttgccccagcccaattcccagcccaaccctaactgacccctgagcttcccagccttgccgcctcacccccctgttgtcctaggaggccaggaaaggagcccacctgcttctcatcaccagccccctggaggtagacagccagcttgtcactcacctgtggttagggatccagagtgatgcccttggagtctgctccccactttccccaaggagggtttctggtcagcctgaggtcctcccctgtcaaatcccatggtggcctctgtgccatctcaggcatggagattggggcccaccttgaacaccttgggtgtccagaggaggatggtgcctgagaggaggtcctacagccctttggacccaactccagtgggggccctagctagaagtggaggtgaagctttcagggctgctctcagctggatgtactgggagccagccctgcaaggagggtctctggctcagtgtcagaaccacagccctttcctcctctagacattgggactccagcaaagaggggaccctggccctggggtcttcccaggggagtcagcaggggggcagtctcacccccacccaggaatttgaaggacttcagaaccctccccagacacctctactgggtgcatggggaaatctagcacaggcagggagactggggagaccaggaagaggcttaaccagagggtaggggcacatgggggtggggcttgtcagccgtgggcccgcccaggatacaaggacccaactcaggcttctggaagcagagggctcttatcctgaagcccaagttcccagcatgtccactccatctggggcctggggagcccacagaacttttcagtttccttcattagctgaatcagatgagatggggaggggataaagtcttgaggatacatgagtggaggagcaggaagtgggctcagaaggcactttcataaccagatccctctgtttgtgggagggcaagcctttgttgcccaaggcttcagctctctgcctgcaagtccacaccccagggagttgagattttgcccaaagccttccgcagaggcccgagcccatccttaccatgccccatcctctaggaagaggtctccatcttccccaaacccctttcagtttgtggggatgcagagagctaccctcagagctttggaggagggttgtagactgggcagggatggtttgccccacagacaagatgatcccccctggcatgttgttaggggcaaattgctgtcctgctcagagtggcatctttcaatgttgcctccatcttggccaagaggtccctgcctcctgatccggcacagctgagctgaggcagatgtgaccagttttcaagctaccagccctgggcagaggaagatgtcaacaattccagagcagagggaagaggcaccttccttgaccacaccagtggcctcctgaagttccatgcttttaagagctgggaccttgggaggatgattcaaaccctcaattcctcctccctgggaactttttaccacctttacctatttatcaaaatcatattcatctttaccatcactgtcactgtaatctacattccatcacctttatcaggtgctgctgagtacaaagcacttgggatgggagacacagcactgaattcacaaacattggaccaaactgtttgtccccatctgggttcatgaggccacctctttgctcaatccatgcctcttgccctcagtcaacaagacattcctagagggaaagggctgctgctctgggagtcaacctgagttcctccctcctgggaagctgggttggcaagattctaggacactcacctgcatggacatcacctctgtgacaaatgcttacctgtttctcatcttcagacttggcgatatcaagcctgttctggaccatgaccaggctggctcatatctctggtttagagaaacctatgaataactggggacaaacagactctttggtagcagcagacacatgtgatccatcaagatcaaccaaggttgcaactggagcgtccactgccagagacctttggctcttcaagctcgggacaaaaaagaagactctgttgtcccttggtaacccagtccctgcttttgtagctatcacagcagaaagcaactcttcctgaagaccaaacactcgtcatccacattccttgaatggccaatccttccatctggaggcctggctcagaaagtatctgagtatcctgacaccctctgtgactcaggagcagggatctcaggcagctgatatcaaaaccacccagccccatccccaggaggcgacattccaatgctaggaccaatcccagatatctggtcccgatggtgaaatggaacaaagacctgcttgggaataaaccaaatgatttctcatgacgttgaacataagttctcccaagccatcatcttggtagaaaatgggacttattccttgacaggccccacccccttcagaaagaggcccttgaccctgataggttctctctaaaacccgtatattaacgcatctggccaacttgggttataaaattcagccttgtgttggcaactcgaaacatcaccagagaggtgatgttgaatgagagacacaaggcctccatctctttggggctgaccacagcctgagaaagaaggtctgggttccagtggccaggccgtcccagaaacaacccccatccatccctgtaaatagagtctgtagcaaaataagagctgcttcctccaacttatcacaagtcgccgttggtcctctctaaggagggctctcttctgagttcattgtacaatagttggaaacgtggtgatgtgctgttcgtttatagaaagctgactttttataaatatatatatatactaaaaaaggaaagaaatcccccacagtgtgtgtcgtgctagtgccagagaccatctgtagggatatatcttcatattgtgtgtttcaaattatgcattccaggctctagtgggttctttcaatcttgttcctttatttttttcatttggtatttctctcttgctatataaagaaaaaaagaagtgatgtgtaagaaccaagctatgcttttatacttccattttatacttgatttagctttgttgttcttttgccagaggaacatcaaagggcagagcaaacagagaactagggggataagagagaagaaaagaagaatggagagagaggtttgcccagaaggaaaacgaagagccagattgaaatctgactctggcttgagaacaggacgggtcccagagtttgaccactgccagaatccagtgtttcaagatggagttggtgaagcatccaagattttggatcctgggcctcagtgacactccatcacccaactaaaaagatgttctctgggacctctctcaggctgatgttcttctcatcaagctcccgaatgtgtctcgcactattggacactttttgggggtacacaggtcttctctcctcccctcctgcagaggcaccaaaaccaagaccaaatgggggttctctagccgccaacttgaaacgctctgagacttctgtgtatttgatgcttcttcaagtcagctctgacgtggccaattccctgacctgggaaatatttacatagtactctagatcattccttcttcctagtaactgcaactttgttgcttctgtgtttgactcacagccactttcccccatgcggaagtgagtgggtgtacgtgagggtgtgagtggggtgtgtgcgtgggcgtgtgggcgtgaggtgtgtgtttaaatataatcacaccataatttattcagctatatggagtagtagactagaaagagaaactggtatttgctttaactacctgctgcttgtaagcgcttcctctgtaactcaggcgtaactgttatacattaaaagaaattaaaagca

SEQ ID NO: 331 - protein, 505 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQTAVDYLAKNVSLSTQRRMKLGEHSAVLGLLPVETGQAY

SEQ ID NO: 332 - DNA, 5591 bp, Homo sapiens
gctactcccaccccgccccgccccgtcattgtccccgtcggtctcttttctcttccgtcctaaaagctctgcgagccgctcccttctcccggtgccccgcgtctgtccatcctcagtgggtcagacgagcaggatggagggctgcatgggggaggagtcgtttcagatgtgggagctcaatcggcgcctggaggcctacctggcccgggtcaaggcgctggaggagcagaatgagctgctcagcgcggagctcggggggctccgggcacaatccgcggacacctcctggcgggcgcatgccgacgacgagctggcggccctgcgggccctcgttgaccaacgctggcgggagaagcacgcggccgaggtggcgcgcgacaacctggctgaagagctggagggcgtggcaggccgatgccagcagctgcggctggcccgggagcggacgacggaggaggtagcccgcaaccggcgcgccgtcgaggcagagaaatgcgcccgggcctggctgagtagccaggtggcagagctggagcgcgagctagaggctctacgcgtggcgcacgaggaggagcgcgtcggcctgaacgcgcaggctgcctgtgccccccgctgccccgcgccgccccgcgggcctcccgcgccggccccggaggtagaggagctggcaaggcgactgggcgaggcgtggcgcggggcagtgcgcggctaccaggagcgcgtggcacacatggagacgtcgctgggccaggcccgcgagcggctgggccgggcggtgcagggtgcccgcgagggccgcctggagctgcagcagctccaggctgagcgcggaggcctcctggagcgcagggcagcgttggaacagaggttggagggccgctggcaggagcggctgcgggctactgaaaagttccagctggctgtggaggccctggagcaggagaaacagggcctacagagccagatcgctcaggtcctggaaggtcggcagcagctggcgcacctcaagatgtccctcagcctggaggtggccacgtacaggaccctcctggaggctgagaactcccggctgcaaacacctggcggtggctccaagacttccctcagctttcaggaccccaagctggagctgcaattccctaggaccccagagggccggcgtcttggatctttgctcccagtcctgagcccaacttccctcccctcacccttgcctgctacccttgagacacctgtgccagcctttcttaagaaccaagaattcctccaggcccgtacccctaccttggccagcacccccatcccccccacacctcaggcaccctctcctgctgtagatgcagagatcagagcccaggatgctcctctctctctgctccagacacagggtgggaggaaacaggctccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcaggatggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcccggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctgggaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcccccaggaggaaggggaggagagcagagaagagagcgaggaggatgagctcggggagacccttccagactccactcccctgggcttctacctcaggtcccccacctcccccaggtgggaccccactggagagcagaggccaccccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggccctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaaaaaaaaaaaaaaaaaaaaaaaaaaaaaaaaaaa

SEQ ID NO: 333 - protein, 1621 aa, Homo sapiens
MEGCMGEESFQMWELNRRLEAYLARVKALEEQNELLSAELGGLRAQSADTSWRAHADDELAALRALVDQRWREKHAAEVARDNLAEELEGVAGRCQQLRLARERTTEEVARNRRAVEAEKCARAWLSSQVAELERELEALRVAHEEERVGLNAQAACAPRCPAPPRGPPAPAPEVEELARRLGEAWRGAVRGYQERVAHMETSLGQARERLGRAVQGAREGRLELQQLQAERGGLLERRAALEQRLEGRWQERLRATEKFQLAVEALEQEKQGLQSQIAQVLEGRQQLAHLKMSLSLEVATYRTLLEAENSRLQTPGGGSKTSLSFQDPKLELQFPRTPEGRRLGSLLPVLSPTSLPSPLPATLETPVPAFLKNQEFLQARTPTLASTPIPPTPQAPSPAVDAEIRAQDAPLSLLQTQGGRKQAPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKELLKDVEVVRPLEKEAVGQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINQGAMNPLEKEIQEPLESVEVNQETFRLLEEENQESLRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGPGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 334 - DNA, 2490 bp, Homo sapiens; identical to SEQ ID NO: 154

SEQ ID NO: 335 - protein, 236 aa, Homo sapiens; identical to SEQ ID NO: 155

SEQ ID NO: 336 - DNA, 3435 bp, Homo sapiens
acagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaagattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaataaaaa

SEQ ID NO: 337 - protein, 326 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 338 - DNA, 1367 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagctgcgctggaacactcatcgtcctgcaccatggcatgcgctttcaagactctgcttgctcatacgctgtttgctctgcttggaatgtgcttacccccttccccttcatctggtgaactcctactcatccaagacccagcttcattgtctccatctctgggaagcctgccctgcatactccaggcagaaccaatcctttcctccataatgcttccctggtgctttgccattgtatttgtgacttgtttgtctgcttcagctagactgtgagctccatgagggcagggaccatgtctttttttgcttttgcacacggtaggtacttaatattgctttatgtttatttgatttaccatccacctcattctagaagtgtatagtggtaataaatgtttattaaataaataaattataccgtacattaaaaaaaaaaaaaa

SEQ ID NO: 339 - protein, 302 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKLRWNTHRPAPWHALSRLCLLIRCLLCLECAYPLPLHLVNSYSSKTQLHCLHLWEACPAYSRQNQSFPP

SEQ ID NO: 340 - DNA, 2151 bp, Homo sapiens
gctttccttttagcttttgtaagttacacgtcaaaatggccgatctgacatcggtgctcacttctgttatgttttctccctctagtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagactatttgccggtttcacaagacataatttttatcaactagctcttaagagaggcatagcaaagtgggggttgctaccatttctagagagagaggacacagtcccggcctgggctgcccccgctccagtcaatgctcactgaaagtctgtcttagctgcctgtttgaatgactgttctttttctcatttttaattcttggactcatgtcctcattgcttcactcaattaaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgagaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcattaaagatgcttgatgtaataattggttagtttccttttattttcctgcaggcttttccatgagtattatttttttcaaagaacaaatctgtatggcttttccccatctccatattttgttttgctatgaattgctttgctttggtgaacttgtcctagtatgcttgcctcacaaacgttttagccattgtgaattttcttcatctctgtaaatagttcatctgtgcttctccctgatgacgttttattttttttcccctgtaagcaaccgaggtagaaaaataaattgtttaccatggaaaaaaaaa

SEQ ID NO: 341 - protein, 251 aa, Homo sapiens
MADLTSVLTSVMFSPSSKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPDYLPVSQDIIFIN

SEQ ID NO: 342 - DNA, 3048 bp, Homo sapiens
gtagagatgccacactcgctccgcggttcgcatggcgctctgaagacgccggcgcccgccgccttgaggagccgctgcccccgctccctgaagatgggggaacaatgaaataagcgagaagatccctcttctcccccctctctctcttgccccctccccccctcccctcccctctccccttgactcctctccgaggcaccatgctgacccgcctgttcagcgagcccggccttctctcggacgtgcccaagttcgccagctggggcgacggcgaagacgacgagccgaggagcgacaagggcgacgcgccgccaccgccaccgcctgcgcccgggccaggggctccggggccagcccgggcggccaagccagtccctctccgtggagaagaggggacggaggccacgttggccgaggtcaaggaggaaggcgagctggggggagaggaggaggaggaagaggaggaggaagaaggactggacgaggcggagggcgagcggcccaagaagcgcgggcccaagaagcgcaagatgaccaaggcgcgcttggagcgctccaagcttcggcggcagaaggcgaacgcgcgggagcgcaaccgcatgcacgacctgaacgcagccctggacaacctgcgcaaggtggtgccctgctactccaagacgcagaagctgtccaagatcgagacgctgcgcctagccaagaactatatctgggcgctctcggagatcctgcgctccggcaagcggccagacctagtgtcctacgtgcagactctgtgcaagggtctgtcgcagcccaccaccaatctggtggccggctgtctgcagctcaactctcgcaacttcctcacggagcaaggcgccgacggtgccggccgcttccacggctcgggcggcccgttcgccatgcacccctacccgtacccgtgctcgcgcctggcgggcgcacagtgccaggcggccggcggcctgggcggcggcgcggcgcacgccctgcggacccacggctactgcgccgcctacgagacgctgtatgcggcggcaggcggtggcggcgcgagcccggactacaacagctccgagtacgagggcccgctcagccccccgctctgtctcaatggcaacttctcactcaagcaggactcctcgcccgaccacgagaaaagctaccactactctatgcactactcggcgctgcccggttcgcggcccacgggccacgggctagtcttcggctcgtcggctgtgcgcgggggcgtccactcggagaatctcttgtcttacgatatgcaccttcaccacgaccggggccccatgtacgaggagctcaatgcgttttttcataactgagacttcgcgccggctcccttctttttcttttgcctttgcccgcccccctgtccccagcccccagagcgcagggacacccccatcctaccccggcgccgggcgcggggagcgggccaccggtcctgccgctctcctggggcagcgcagtcctgttacctgtgggtggcctgtcccaggggcctcgcttcccccaggggactcgccttctctctccccaaggggttccctcctcctctctcccaaggagtgcttctccagggacctctctccgggggctccctggaggcacccctcccccattcccaatatcttcgctgaggtttcctcctccccctcctccctgcaggcccaaggcgttggtaagggggcagctgagcaatggaacgcgtttccccctctcattattattttaaaaacagacacccagctgccgaggcaaaaaggagccaggcgctccctctttcttgaagagggtagaagttagggcgccggagcccgggcctggaacgccctcacccccaacctccagtctccgcgttttgcgattttaattttggcgggaggggaagtggattgagaggaaagagagaggccaagacaatttgtaactagaatccgtttttcccttttcctttttttaaacaaacaaacatacaaaaaaaaaaaaaaaaaaaaaaaaaaaaaaaaaaaaaaaagctaagaggcgacggaagccgaacgcagagtccggatcggagagaaaacgcagtaaggacttttagaagcaataaaaggcaaaaaaaacaaaaaacaaaaaaacaaacaaaaaaaaaccactactaccaataatcaaagacacaaatatctatgcaaggaggctccactgagcctcgcggcccggcccggccccgggatgccccgcccggcctgcgggccgccccgcccgagcgcggatctgtgcactttggtgaagtgggggcccgcgccgccccctccccctccccaggttcttacaatcagtgactcggagatttggggccccagtgccactgccctcccccgccccgtccccgttgtgcgtcatgctgttttttaaaaacctgtttccaaatttgtatggaatggcaaactgttggggggtcggtttggggagggagggtttgcatgaaagacacacgcacaccacaccgcacgcacaagcaggcccggcgccggcgtccggggggcagaaggaggtgagctcgccggctcctcctccccgcggccattctgtcccctcctggggtgaggggtggggatggagacctgggggcagccccacccctgcccggactgtgcctcggtgggtgccacctggcgatttccggtgtctggagagagtattttttggtccaaggagtcctcttggctttagctggtgggtgggcggggagaggtctgagggctcctactggaggttcccccaaaaaggggcaaaaggagaccctctgcccaccggaggcaggggatcaggcatccaaatacacgatgcaaaaatgcaatcccacaggcgacacacccacacactcacccacacacacgcaattttaccttcctcttgtagcgaagatgaaactcccgtcggacacccgaagtgcattgcgtgtttctgttcagtttaatgacgattaataaatatttatgtaaatgagatgcaaagccggaaaaaaaaaaaaaaaaa

SEQ ID NO: 343 - protein, 382 aa, Homo sapiens
MLTRLFSEPGLLSDVPKFASWGDGEDDEPRSDKGDAPPPPPPAPGPGAPGPARAAKPVPLRGEEGTEATLAEVKEEGELGGEEEEEEEEEEGLDEAEGERPKKRGPKKRKMTKARLERSKLRRQKANARERNRMHDLNAALDNLRKVVPCYSKTQKLSKIETLRLAKNYIWALSEILRSGKRPDLVSYVQTLCKGLSQPTTNLVAGCLQLNSRNFLTEQGADGAGRFHGSGGPFAMHPYPYPCSRLAGAQCQAAGGLGGGAAHALRTHGYCAAYETLYAAAGGGGASPDYNSSEYEGPLSPPLCLNGNFSLKQDSSPDHEKSYHYSMHYSALPGSRPTGHGLVFGSSAVRGGVHSENLLSYDMHLHHDRGPMYEELNAFFHN

SEQ ID NO: 344 - DNA, 2012 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgaaaaaaaaaaaaaaaaaaaaaa

SEQ ID NO: 345 - protein, 537 aa, Homo sapiens
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 346 - DNA, 2521 bp, Homo sapiens
aaaaaccggccgagcccctaaaggtgcggatgcttattatagatcgacgcgacaccagcgcccggtgccaggttctcccctgaggcttttcggagcgagctcctcaaatcgcatccagattttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaaaaaaaa

SEQ ID NO: 347 - protein, 323 aa, Homo sapiens
MDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 348 - DNA, 2196 bp, Homo sapiens
agttcaagcacacaccaactagctgtccaggaagcagcctaaccagagagaggggcgtgggagggagagaggcggggaaaagcagcgtctccgcttttcttctcacgtcttgccgcggagaagtgggttcctgggcagtgcagattttttttttttaattcaagattttctttaatttcccgcctaaagcctccccacggtagggccgcatcccctgtaataaaatgaattctgattcgagctctgtctccagcagagcttcatctccggacatggatgagatgtacctgagggaccaccaccaccgccaccaccaccaccaggagagccgtctcaactcggtctcgtccacgcagggcgatatgatgcagaagatgcccggggaaagcctctcgcgggctggcgccaaggccgcgggagagagcagcaagtacaaaatcaagaagcagctgtcggagcaggacctacagcagttgaggctgaagatcaacggacgcgaacgcaagcggatgcacgacctgaacctagccatggacgggctgcgcgaagtcatgccctacgcgcatgggccgtcggtgcgcaagctctccaagatcgccacactcctgctcgccagaaactacatcctcatgctcaccagctccctggaggagatgaagaggctggttggcgagatctatgggggccaccactcggcctttcactgcgggaccgtgggccactcggccggccaccccgcgcacgcggccaactccgtgcacccggtgcaccccatcttgggcggcgcgctctcatctggcaacgcctcgtcaccgctgtccgccgcctcacttcccgccatcggcaccatccggcctccccactcgctactcaaggcgccctccacgccgcccgcgctgcagctgggcagcggcttccagcactgggctggtctgccctgcccctgcaccatctgccagatgccgccgccgccgcacctgtccgctctctccacagccaacatggcccggctgtcggccgagtccaaggacttgctcaagtgagcagcgggcgggcccggctgccaaggaggagggagagcggcgggaggggccgcggtgccgggccgggagggaagagggaggctgcacgctcggcccacgggagggcaggctccggggcccgcagcctcccacgctgtctgagagatctcagactccacttgacccccggagggaaaggaccaaaatcaaaccgcaatttctaggtggtagcaaagggggactcgaaccagatgtcgtgtgttttgcatgcatgcttcttttccccatgccgcgccagtatttttcactgccatatgctcttgtcaaaactgcatttgttgtataaagatgggatcggtgtagttaaaaacttgcgaagggacttttgagttggctttctctgactctgtgttctcgctttggaaaaagacggccatcccttttgtgcaaaacaaatgtaaatattttcttgagatggatgcgattatgattgtctctgtccttgccacagtttttctagagacaatggagagagaaagagagagagagcgcgagagagatcaagacccaagttttgaatctcaaccgaggtccagggcatgacacctcctatgtgggttttcctttcgacgcagtgtaggtcaaaagaatgcatgcacgcttctaaatgaatcttgtctgaatatgtcgtgcaggctgtggtgccgttttccttgtaacaaggatttattagtgaattatcccaagtactccatatatctgtctgtggttgtatgaaatgaaaaaaggggcagagtgcaaagacccacactcacgcacacgcgcttcttctcccacccccacccccttcaaactttattcggaaccttcctttgctgttctggggccgctattgtaaaagcctgggctccctctagtagcttgcgccaccccccctcgctcagttattctgcatgcggggttggctctctctattatcagctttgaaaacttatcctggttttgggaggggtgccgtttttattttcctgaacatttgcttgaaatattttgttagggcctcaaagacgatacctgtctttattttttatatattcttgataactatgatatatttattaataaccagtgtttctggatgagatttcaaataaaaaagaacctttaaatcgtg

SEQ ID NO: 349 - protein, 272 aa, Homo sapiens
MNSDSSSVSSRASSPDMDEMYLRDHHHRHHHHQESRLNSVSSTQGDMMQKMPGESLSRAGAKAAGESSKYKIKKQLSEQDLQQLRLKINGRERKRMHDLNLAMDGLREVMPYAHGPSVRKLSKIATLLLARNYILMLTSSLEEMKRLVGEIYGGHHSAFHCGTVGHSAGHPAHAANSVHPVHPILGGALSSGNASSPLSAASLPAIGTIRPPHSLLKAPSTPPALQLGSGFQHWAGLPCPCTICQMPPPPHLSALSTANMARLSAESKDLLK

SEQ ID NO: 350 - DNA, 2074 bp, Homo sapiens
atgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaggcaagagtagtgcgaacgcagccggcggcgcgaactcgggcggcggcagcagcggtggtgcgagcggaggtggcgggggtacagaccaggaccgtgtgaaacggcccatgaacgccttcatggtatggtcccgcgggcagcggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatctgagcaccggcctgcgctcgtccacccttgttccccacccccacccccactcccgccccgcacccccaagttgggacgccttgtttagctttgcttgcctgggactgttgccttgtaccgatgatggggagggctgaaagttttgctgtagctgtcgggttttgtacaaaagcaaaaataagtcaggagcagcgaaaatgggacttctagagagctctcttgccccacgccgctgctcctttcacctttgtaggctgggaatcgctgtgttatttgcaaagaaaaaacagcccccactcctcctcctgagttccagggttattctgttacatttgaaaatgttgtcttgttagtttgcagttagccaaggagtgaatgggagaaacatagtatcgggtgaggccagctggagaactgcaacgcctacgcccccagtcgtgtcgcgtctgttttcctcgtggttttttggggcgctgaccgctccaagcagcgcggcagctaaagccaatgttaatttatagccaggtgtgcgtgtgtctcccgcctcgccgcccctggccgcgggacagcttctgtccaatcatgttgagttggtgatttctgccgtgatctgtttgatatttcttcgcgctaatgtgttcagatttcgtttgggtagtggggaggggctactttgtttcagggttttcaagcttttactcttaattcctaaatgagatcaataaattttataacc

SEQ ID NO: 351 - protein, 446 aa, Homo sapiens
MRPVRENSSGARSPRVPADLARSILISLPFPPDSLAHRPPSSAPTESQGLFTVAAPAPGAPSPPATLAHLLPAPAMYSLLETELKNPVGTPTQAAGTGGPAAPGGAGKSSANAAGGANSGGGSSGGASGGGGGTDQDRVKRPMNAFMVWSRGQRRKMALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 352 - DNA, 3963 bp, Homo sapiens
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaaaaaaaaaaaaaaaaaaaaaaaaaaaaaa

SEQ ID NO: 353 - protein, 509 aa, Homo sapiens
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 354 - DNA, 2882 bp, Homo sapiens
gtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttaaaaaaaaaaaaaaaaaaaaa

SEQ ID NO: 355 - protein, 466 aa, Homo sapiens
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 356 - DNA, 8737 bp, Homo sapiens
acctccgcacgagacccagcggcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaatttaattttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggtttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggggagcagggggtggcagagggcacccgggcggtagtccgggacgcgcaaggcagagccctgacgctccgggtccccgtgcctggctcttcttgcctcgccaccgcgtgctcctgggcgcgccccgccgcgggcccttgaggcgcgcggagacaccagcgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaagcgtccgcacagtaactgcagctgctaggccagaggggccccggcgcccttcccgcctcccctcccgcttgcttttgccttactcgatcttaccaccacccctcccccggccccccgactgagaactcgggcctctcacccgccccccagcctcccgctctgggcgagcctcctccccagcccccacccctgggatgcgaagccagcaagcttttgctgcagatggacaggtttcttttctgtggctttttcctttcgataaaccatcagatttcagtagtacatttgggaaaagaaggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagctagagaaagaaatcattacaactcttttgggcagagatgtttctttttaatgttaatcaaggggaagtgatttaaatatgcataaatgtagcagtcagggtgatttagttgcttttttcatgaaagaaaaagactcaaaagacaagacttatttttctcttctgggacttgaaatcataatcatctgatattagtacagtacaagaaatttacatttgttttttacttcagaatttaagtgacttttgcccaaggaatttgagaaataaggcaaataagttgctctattttaaagtagtcattcaatataaatatattatatcaatcttaacttttttattctctgatatgattaataatatgtatattcttacttttcttctaatgggcatatgtatccttgtggacactttgagagaggttttcttggactctcccatttatagaatctttatactcttttactgtgtggttccctgcttttaacagatttctgaggcaaatatatttgtgcttttttcttatgtaggaagaccagcgaaaatagtttactgagttgtcaattttatcagtagataagaaactttctttattacagtttcagggaagattttttcaggatatttctcagttattctaagggccaaattttgtaaaatttccattaggaatgtcagtttcaaataccctttgtatagcctaagcctgtgaggataacaagaatgagccttacctatcctaacacagggatttacaagttcccaaagtaaccgtctccatgtaactcttgacatacttttctgagatttggcttatttttattattggttatttctcactgttcattctatttgatttattctacaacatccccttttatttaatgatctggaaaattctgctctttgataacaactcaggatttttttgttcagttttggtttttgccccttcctgtggagcctacattttcaaccacaataaagatgaaacaaaatttatgaaactgagctctcttccattttacttactgctggcttttttttttttttttttccttgattcctaccataccttcgtttttttcattgtacttttttaacactacctatatccattagctgcctaattagttttatctgttccatgtggatgcagtgagtttataagagaatttcacaaacaagtagttttttagtgaacttaaaataaacagaattttaaaggagacctatttttatactcaataaaagcacaaaagtgcagaaagtataaaacggcttacaaagggagacacaagctcataatgttccatgtataaaagtaataactttattgggtagagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggtgaatttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagagatttttttaatatgatgcttgtcttactttcttagacacgttacatttccccttccaaaaaaaaaaaaaaggacaactggaagtaatttatcatataaagaattttgatcaaatagatattgacaaagggccctctgtcacatttttcttcatccagcttttgttcaaaaacagtatgcctcctcccttgaatcacatagggagaaacgttatactccattctcattaatttcccattttgtctacttttactcttgtacatatgttgtgggtttaagagtcttttgcatttgttctgtgacacctttttttgaattgactgttttaaaacggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagtttgcatgccagcgcacggcctattgctgtgaaacagagagaaggtaaagctacctgaggcagtgcgctggaggatgaagtgtttgatagcactaggggggaaagaaaatgcatggcaaagtttcgtcttctcgtagactatctagcatgcagagtgtagtgtgttgaaacggtgtatgacattgctgtatcaaagttgtaaaattaagcattatttattgaaaactatgtatttttttgtaaaaacctgatcacatagagaatatcagtggcttgtgcttgtgcttcgatctaaccagcttcttgacccacccccccttggtatgcagtgttaatgctcagggttgaaaatagtacactccaatgtctcttttgcaagagtttttcacagaggattacatttgttcaaaagactctaataaaattgtgtgatcaatcttcaaaaaaaaaaaaaaaaaaa

SEQ ID NO: 357 - protein, 441 aa, Homo sapiens
MVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGKLKAPAAAGAKAGAGKAAQSGDYGGAGDDYVLGSLRVSGSGGGGAGKTVKCVFLDEDDDDDDDDDELQLQIKQEPDEEDEEPPHQQLLQPPGQQPSQLLRRYNVAKVPASPTLSSSAESPEGASLYDEVRAGATSGAGGGSRLYYSFKNITKQHPPPLAQPALSPASSRSVSTSSSSSSGSSSGSSGEDADDLMFDLSLNFSQSAHSASEQQLGGGAAAGNLSLSLVDKDLDSFSEGSLGSHFEFPDYCTPELSEMIAGDWLEANFSDLVFTY

SEQ ID NO: 358 - DNA, 2537 bp, Homo sapiens
ctccgcgggcagccaacattgatttcctccgggccgagggcgagggcccgggcggcggcgggctgcagccgcggcagggcgagagcatgtccaagccggtggaccacgtcaagcggcccatgaacgccttcatggtgtggtcgcgggctcagcggcgcaagatggcccaggagaaccccaagatgcacaactcggagatcagcaagcgcttgggcgccgagtggaaactgctcacagagtcggagaagcggccgttcatcgacgaggccaagcgtctacgcgccatgcacatgaaggagcaccccgactacaagtaccggccgcggcgcaagcccaagacgctgctcaagaaggacaagttcgccttcccggtgccctacggcctgggcggcgtggcggacgccgagcaccctgcgctcaaggcgggcgccgggctgcacgcgggggcgggcggcggcctggtgcctgagtcgctgctcgccaatcccgagaaggcggccgcggccgccgccgctgccgccgcacgcgtcttcttcccgcagtcggccgctgccgccgccgctgccgccgccgccgccgccgcgggcagcccctactcgctgctcgacctgggctccaaaatggcagagatctcgtcgtcctcgtccggcctcccgtacgcgtcgtcgctgggctacccgaccgcgggcgcgggcgccttccacggcgcggcggcggcggctgcagcggcggccgccgccgccggggggcacacgcactcgcaccccagcccgggcaacccgggctacatgatcccgtgcaactgcagcgcgtggcccagccccgggctgcagccgccgctcgcctacatcctgctgccgggcatgggcaagccccagctggacccctaccccgcggcctacgctgccgcgctatgaccccgcggggccgcctcgcgaggaccggtgtgcacacgtgtacatatgtataggtacgagcgctgcggcctccccgtgcgccctcccgcgaccgggggcccggtttgtatgtacatagaatgtataggtgccaggtagaggcagagaggccaggcggggcaggagtggccaagcgcgcaagggcgcgggcgagcaggcctgtgaattcgcaggatcatttcagacccgcacttcggcagccaactcgaaagcaggcggttgtgtgcggcagcagttggcgtttgctttgcacttcggaacctgttgcgttttgacccacggaggtggaggagtaactttttgacatgttggcctttccagttttgttggaagtttcatggtcggttttgtttttgtttctcattcttcttcctcgcccctcagccccccaacccccaaccccctcccggtccgtgttgcatgcacgctgttcaaatgtgaggtctgaaatggctggcacacgggaaaagctgcttgtgtcattcgtttctgggagtgggatggctctgagcagcctcgcctccctgtttgtactatttgaactttgcagatctctgttctctcaagcagaactcccaaccagatccattcttgaccagtgaccggctcgaatctggccttttgtgtgagatgatcacggtttcttttgtttatcacgccatttgcaaatcagagcaagagctctttctcaagggcaagaaacgcaaacaagaaatatttgtgagatgaaagttgtcaattggattttcttcctaaacaaacaacaacaacaaactactagaagtctccctgagtccactcgcttggatttctgacacagtttacaaaaaaggaaaaaggcactgctcctattttcccttatggctgagttcaccttaagattgtaaatgtgtatatgtcagtgaaaacattgaggcttggaaaatgtgttattttcgttgccctaagtttgagtcgactttagactcaaaaacattttgagcgaatatcaaagttaacttttaaaaattgcgaaactatttcagaatcgcaattttatcgaagattaaatcagacttttttgtctggtaattatatatttattatttagcaaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatatattttgactaatgtttgtgaatgaagttggctaacatgtatttagtttcattttggctttatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagagtttaaataaagcctgaaccagggaaaagaaaaaaaaaaaaaaaaaaaaaaaaaaaa

SEQ ID NO: 359 - protein, 276 aa, Homo sapiens
MSKPVDHVKRPMNAFMVWSRAQRRKMAQENPKMHNSEISKRLGAEWKLLTESEKRPFIDEAKRLRAMHMKEHPDYKYRPRRKPKTLLKKDKFAFPVPYGLGGVADAEHPALKAGAGLHAGAGGGLVPESLLANPEKAAAAAAAAAARVFFPQSAAAAAAAAAAAAAGSPYSLLDLGSKMAEISSSSSGLPYASSLGYPTAGAGAFHGAAAAAAAAAAAAGGHTHSHPSPGNPGYMIPCNCSAWPSPGLQPPLAYILLPGMGKPQLDPYPAAYAAAL

SEQ ID NO: 360 - DNA, 3939 bp, Homo sapiens
gcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgcagcagttctgaaatgatgctatgggaaaaaaattgcaaaatatgtatttttaaagttcatgatttgtaggcaaagatgttaagagcattgtttccattaaaatcaataacaatgaaaaacggttgtttgctttgtgataaaatgttaacaatccatttaatcttcagtgaagcaactcatttggacaaacagttcttttacagtggttatatggaaaagaaattgattgctattttggggggctggagtgggtagagtattgagaccttttttattagggtgctgtttgttattgagagcccaatctctgcatgaataacagaaaggtggacataaggaattgtaaagtatttagaatgtattgaataggcttaagtacctcctttaaggggcaatgctctaggtttttggtggcagtcaatttggtattatatatgatcattttcaattctagaattttgtttattgttctttttgaagaaataaagtcttggcacatcttatttatgttataa

SEQ ID NO: 361 - protein, 467 aa, Homo sapiens
MTMLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKVHESQGSDSSPAASSGYESSTPPAIASANSKDTTKTPSAVQTSTSHNPGLPPNFNEWYV

SEQ ID NO: 362 - DNA, 1722 bp, Homo sapiens
attcattgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaaaaaaaaaaaaaaa

SEQ ID NO: 363 - protein, 264 aa, Homo sapiens
MPRSFLVRKPSDPNRKPNYSELQDSNPEFTFQQPYDQAHLLAAIPPPEILNPTASLPMLIWDSVLAPQAQPIAWASLRLQESPRVAELTSLSDEDSGKGSQPPSPPSPAPSSFSSTSVSSLEAEAYAAFPGLGQVPKQLAQLSEAKDLQARKAFNCKYCNKEYLSLGALKMHIRSHTLPCVCGTCGKAFSRPWLLQGHVRTHTGEKPFSCPHCSRAFADRSNLRAHLQTHSDVKKYQCQACARTFSRMSLLHKHQESGCSGCPR

SEQ ID NO: 364 - DNA, 3828 bp, Homo sapiens; identical to SEQ ID NO: 281

SEQ ID NO: 365 - protein, 518 aa, Homo sapiens; identical to SEQ ID NO: 279

SEQ ID NO: 366 - DNA, 855 bp, Homo sapiens
atgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacggggaaaaccaggacaaaagaaaagtatcgtgtagtttacactgatcatcaaagattggagctggaaaaggaattccattgcaatagatatatcaccatccagagaaaatcagagctggcagttaacctgggcctttccgagagacaggtgaaaatctggtttcagaatcgcagagccaaggagagaaagatgatcaaaaagaaaatctcccagtttgagaatagtggaggctcggtgcaaagtgactctgactccatcagccctggggaactacctaacacttttttcaccacaccatctgctgttcgtggatttcaacctattgagatacagcaggttatagtctccgaatga

SEQ ID NO: 367 - protein, 284 aa, Homo sapiens
MYGSCLLEKEAGMYPGTLMSPGGDGTAGTGGTGGGGSPMPASNFAAAPAFSHYMGYPHMPSMDPHWPSLGVWGSPYSPPREDWSVYPGPSSTMGTVPVNDVTSSPAAFCSTDYSNLGPVGGGTSGSSLPGQAGGSLVPTDAGAAKASSPSRSRHSPYAWMRKTVQVTGKTRTKEKYRVVYTDHQRLELEKEFHCNRYITIQRKSELAVNLGLSERQVKIWFQNRRAKERKMIKKKISQFENSGGSVQSDSDSISPGELPNTFFTTPSAVRGFQPIEIQQVIVSE

SEQ ID NO: 368 - DNA, 4049 bp, Homo sapiens
agagaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaattctttctctgggtcatccactgctgagccccctccccaggaagtggaattgaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagactggtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattctaaaaaaaaaaaaaaa

SEQ ID NO: 369 - protein, 419 aa, Homo sapiens
MTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 370 - DNA, 1501 bp, Homo sapiens
gacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaaaaaaaaaaaaaaaaaaaaaaa

SEQ ID NO: 371 - protein, 413 aa, Homo sapiens
MEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQVNRPLTMRKDGIQTRNRKASGKGKKKRGSSLGGTGAAEGPAGGFMVVAGGSGSGNCGEVASGLTLGPPGTAHLYQGLGPVVLSGPVSHLMPFPGPLLGSPTGSFPTGPMPPTTSTTVVAPLSS

SEQ ID NO: 372 - DNA, 3484 bp, Homo sapiens
actgggtcaagcacagccctgagcggccgcgtgtccgaggcccaggtgccctctagagccctgtagttcctgcccctctctgcccctctcggctcctgctgttccgccgctgtcgtccgaaccatcccaacccccagtccacccagacagcgcccgagctaggggagggaacggtctgggagtcggcagctggcgccagggcggccggaggatgccgaggggccggagccgggagggcccgaggccgaggcgcactctacccccagctcctaccctgtaagccccgccagcctccggacgtgctgtccctgggcccgtcgccctcggggctcccgccggaactccttcactctcagaggccgagtccctcccctccccacggctgcgtgtggccgttgccgtctgcacccagaccctgagccgccgccgccggccatggaggtggcgcccgagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccaaaaaaaaa

SEQ ID NO: 373 - protein, 480 aa, Homo sapiens
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 374 - DNA, 2042 bp, Homo sapiens
ggaaaacgagtcaggggtcggaataaattttagtatattttgtgggcaattcccagaaattaatggctatgagttcttttttgatcaactcaaactatgtcgaccccaagttccctccatgcgaggaatattcacagagcgattacctacccagcgaccactcgcccgggtactacgccggcggccagaggcgagagagcagcttccagccggaggcgggcttcgggcggcgcgcggcgtgcaccgtgcagcgctacgcggcctgccgggaccctgggcccccgccgcctccgccaccacccccgccgcccccgccaccgcccggtctgtcccctcgggctcctgcgccgccacccgccggggccctcctcccggagcccggccagcgctgcgaggcggtcagcagcagccccccgccgcctccctgcgcccagaaccccctgcaccccagcccgtcccactccgcgtgcaaagagcccgtcgtctacccctggatgcgcaaagttcacgtgagcacggtaaaccccaattacgccggcggggagcccaagcgctctcggaccgcctacacgcgccagcaggtcttggagctggagaaggaatttcactacaaccgctacctgacacggcgccggagggtggagatcgcccacgcgctctgcctctccgagcgccagatcaagatctggttccagaaccggcgcatgaagtggaaaaaagaccacaagttgcccaacaccaagatccgctcgggtggtgcggcaggctcagccggagggccccctggccggcccaatggaggcccccgcgcgctctagtgcccccgcacgcgggagccacgaacctcggggtgggggtgggcagtgagtgcaggggatggggtggggggacaggagggggccctggggcctgggccccggaaaaatctatctgccctcccccacactttatatacgaataaacgcagaagagggggaggggaagctttatttatagaaatgacaatagagggccacggggaggcccccccagaagcaagattcaaatctcttgctttctttcttaaaaaaaagaaaaagaaaaagcaagaagaaggaagaaagaaaaagacagaaagagaaataggaggaggctgcagctcctcgttttcagctttggcgaagatggatccacgtttcatctttaatcacgccaggtccaggcccatctgtcttgtttcctctgccgaggagaagacgggcctcggtggcgaccattacctcgacacccgctaacaaatgaggcccggctcggccgcctccgcctctgctactgccgctgctggaagacagcctggatttcctttctttgtcccccactcccgatacccagcgaaagcaccctctgactgccagatagtgcagtgttttggtcacggtaacacacacacactctccctcatctttcgtgcccattcactgagggccagaatgactgctcacccacttccaccgtggggttgggggtgggcaacagaggaggggagcaagtagggaagggggtggccttgacaactcaggagtgagcaggaaaattgagtccaaggaaaaagagagactcagagacccgggagggccttcctctgaaaggccaagccaagccatgcttggcagggtgaggggccagttgagttctgggagctgggcactactctgccagtccagagttgtacagcagaagcctctctcctagactgaaaatgaatgtgaaactaggaaataaaatgtgcccctcccagtctgggaggaggatgttgcagagccctctcccatagtttattatgttgcatcgtttattattattattgataatattattattactatttttttgtgtcatgtgagtcctctctccttttctctttctgacattccaaaaccaggccccttcctacctctggggctgcttgagtctagaacccttcgtatgtgtgaatatctgtgtgctgtacagagtgacaatagaaataaatgtttggtttcttgtgaccagcaaaaaaaaaa

SEQ ID NO: 375 - protein, 251 aa, Homo sapiens
MAMSSFLINSNYVDPKFPPCEEYSQSDYLPSDHSPGYYAGGQRRESSFQPEAGFGRRAACTVQRYAACRDPGPPPPPPPPPPPPPPPGLSPRAPAPPPAGALLPEPGQRCEAVSSSPPPPPCAQNPLHPSPSHSACKEPVVYPWMRKVHVSTVNPNYAGGEPKRSRTAYTRQQVLELEKEFHYNRYLTRRRRVEIAHALCLSERQIKIWFQNRRMKWKKDHKLPNTKIRSGGAAGSAGGPPGRPNGGPRAL

SEQ ID NO: 376 - DNA, 1645 bp, Homo sapiens
tcagagttcacgaggcagccgaggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggcgctggcgctgcaaccggtgtacccggggcccggcgccggctcctcgggtggctacttcccgcggaccgggctttcagtgcctgcggcgtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacagggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataaaaaaaaaaaaaaaaaaaaaaaaaaaaaaaaa

SEQ ID NO: 377 - protein, 362 aa, Homo sapiens
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGHFQLFRGLQGPAPGPATSPSFLSCLGPGTVGTGLGGTAEDPGVIAETAPSKRGRRSWARKRQAAHTCAHPGCGKSYTKSSHLKAHLRTHTGEKPYACTWEGCGWRFARSDELTRHYRKHTGQRPFRCQLCPRAFSRSDHLALHMKRHL

SEQ ID NO: 378 - DNA, 1605 bp, Homo sapiens
agagggaagctgagcgaaaatagaccttcccgagagaggaggaagcccggagagagacgcacggtcccctccccgcccctaggccgccgccccctctctgccctcggcggcgagcagcgcgccgcgacccgggccgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaaaaaaaaaaa

SEQ ID NO: 379 - protein, 158 aa, Homo sapiens
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 380 - DNA, 5415 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggcccccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggttcctcaagcactgctgcgtatttaataatgagcttctaaaagcatttcttaagttgcagacctataagattacaaatgtcactcatgttagtataatccacatgcaagtgatgaagccttctctttgatgtgctaaattggagaaggactaatggagctatgaatatacaatagaacatatttaagtagtagtcttgctttaggtaaaacactttcttgaaaccagaggcatttcaaacaataaaacccggctctaatggggatgctctgtgtggatagaaagctactaaaaacactcaggtttattctgatgtgagcagcgattgtgtgcagttcctcccccaatctcaacattgcttaggaaaaaaaaaaatctatgagtttattccacctttcatccattgcatttgtgatgttattagttagcaagatggacactgttctttagaaaggacttatttaatattaaccacgtcatagagcaagatggcccccagtccctacaagcaagtgcaattaaaaataaaagcaaatgttactgagccctgctgaactcctgataaaaaaaattatgtttatggtacatataaatgtctcaatcatgcaaattgtcactcttgttaatgaaacaattttgtaaaaagatagtcctctaaaagggtttaatgttttttacctatctaactgtctaattagatttacacatcccgcaaggcaggggagcctgaagcttttccaaaccaaatcgtttgccactagaaactattttcagctcttcatgatttattaggaaatagtttaacccggactgtagtgtcttataaaatacaaaacgagaaaactgacacaccaaaatgaagtctgtgaaattgtcatcctcttaatattacctgtatttaaattctttcttttgcccttattaacactgatatttgaaacaactaatcatctaaaaggaagctcttaaagggctttaaatgtcaatatagtaagattctaatgtgcactactatttatataaaatatttcttagggcccataaatcatataataaacagtgaacccaagagctacatatggagtctagtgaagagttcccatgtagcctaactaattgtatttaaattgaggagatccaaaaaccccatcacccttcaccccaaagaccccttcacccttcaccagggaattctatcctgggtgctgtcccacctatgaccccttcaagaggccattggaaaaaggccatttacaagttaatgttacttatagctttgttactaagactcacctattgttagtgcagccaagtcacagaagtgcttattgcagttaaatagcaatttgtttccatgaaactgcaattaaagtattactgagcagccattttagattggcagtgctctgaacgcatgttaaacagccagctactcccacttgcagagtctgagatctgactagcagcaaagtgtagcacattcgccgatgctgggtacctagttaaagaggcatttgtagccctctgctcccatcgtgaacatgctgagagcaatgacaagtcagggctgatttttggaaggtgaacttgcaacttacctcaagtgaatactgttttcagttgtgcaagaagtgctttatgctagtagatatgtgcatgtttcctagagggaatgttttcaagttcagattgattctgctgagaatggacggcaactcggaggcctcaagccaataatgtactacaggccctgacatgttacagctgtgtaaacagggccattctatttcctaaatcacaactaataaagcagaggatgaaaatcaaaaaaaaaaaa

SEQ ID NO: 381 - protein, 165 aa, Homo sapiens
MVNPGSSSQPPPVTAGSLSWKRCAGCGGKIADRFLLYAMDSYWHSRCLKCSCCQAQLGDIGTSCYTKSGMILCRNDYIRLFGNSGACSACGQSIPASELVMRAQGNVYHLKCFTCSTCRNRLVPGDRFHYINGSLFCEHDRPTALINGHLNSLQSNPLLPDQKVC

SEQ ID NO: 382 - DNA, 7274 bp, Homo sapiens
catagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 383 - protein, 453 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 384 - DNA, 5018 bp, Homo sapiens
gcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaaacacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaaggggaaaaaaaaaaaaaaaa

SEQ ID NO: 385 - protein, 331 aa, Homo sapiens
MTERPPSEAARSDPQLEGRDAAEASMAPPHLVLLNGVAKETSRAAAAEPPVIELGARGGPGGGPAGGGGAARDLKGRDAATAEARHRVPTTELCRPPGPAPAPAPASVTAELPGDGRMVQLSPPALAAPAAPGRALLYSLSQPLASLGSGFFGEPDAFPMFTTNNRVKRRPSPYEMEITDGPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 386 - DNA, 11191 bp, Homo sapiens
ccgcgcgaacatggccgaagtcggcgaggacagcggcgcccgcgccctgctcgcgctgcgctcggcgccctgcagcccagtgctgtgcgccgcagccgccgccgccgccttccccgcggccgcacccccgccggcccccgcgcagccccagcctccgcccgggccgccgccgccgccgccaccgccgctgcctccgggcgcgatcgcgggcgcgggctcctccgggggctcctccggggtatccggggactccgcggtcgcgggcgcggcgccggccctggtggccgcggcggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggggctgtaaccacaccggctggagtgatcgcagctgccggcccccaggggccaggcaccggggagtgaggtcacctgcaacgcgggggagtgggactcacccagcggcgaccccgaagctggacccggcagctcaggcggccgcacccacagacggaggagaacagcccgcggcggcctgtgggcatcggcggcacctggacacacccagccctttccatttgatcgcctgccttcccgtggtttaagacaaaaacacataaacaagttcagacaactgattgtatgattctgggaattctttgctttcctttccttctccctcggcaccacctcctctccccaggcctccctgtcgggcatggggaggaggttggagctcagcatcttgaggaatgtgtcaagacagcccctccgctccgcgctgcacggccagccgcctttgtccgggaggacagacagaaacgcagcaaggcacacaccaaggctgccggggaggcccgggcaccggacagatgcctgttgggaagccaggagctgccgagccacggaccacctaacagcctctccgcccggaacgtgacatagagagtgttggcattaactcggggggtgtccgatttcacttcagaccccaagtttttctttgtttgtttaaacatggaattcagacttcattgtacacctgagacagacacaaaagggatcatgtatttttgaggattttacctgttgacgtctgatgaccggccgtaggtccagggttcccgctgggtttaatcccctcgaagagtaaacctgccgctctgtctgataacttcaagtaagagcagcggcttcctgggttggcgttcgcggtggaaggttcctaggatgaaaggtgagcctggatccgccggccgcagacatcgcgctgctggggacgattggggccgctgctctgcagaccagaccttcccgaattatccgtggctccgatgtcccggtgctgacggccacatggggacctaacagtgccaaacgccatctgctccagctgctttttcacccagttgcagagtcctcaccactcccacattgatctgctgttttcaattggaaccatttctcctgcctgaaactccagggcccctccctgggctgtccgtgagcaggagaccccaccccagcagcagtggtgagcaggcctgtgcctccacgcccagcccccgccaacgcgactggttttgtttgccacacggtgagaaccggaggacgggatgctccagccagttgggtggttctggggtccctgaggaagccccctcctgcacttccattaagacagccagtggttcctggatctttgtcaccaagcagcgttgagccagagctgtctaatgctgagcccagctcaggaaggagagaggagtccttcagtgtgtcttggagatgcgaagtgcgtcctcgtaaaggtcagctgtcagttttgctggccgctccggcgctggctctcctgtccgggaccacaacgagaaacagcgacagattcgacgcagagctccggaagtgcctgaggagcagtggttcttggaaatcgcccgtcctccgcatcacagcctctcaccagcaaagcagcctctgcccaggccctggcgggagagctgcagagggacccaggtgcctggagggcatttgagggaggtggctggacaggtgtctccctgaagaagaagggagaacacttttcaaagtgattccgaggcagtgcgggaggacacacgtgctgtgcagtggagtggggtcgcccgtggcccccatcagagtccccgtcccccaggacaagtgcagaacctctgtgggccccctccttccacctagatagagaaaaccccttgttcggtttccttcccgtgtcccgttgtttttctaagccccccgaattgagtcgtttctatggcactaacctttccatgggaaataagctctttgtggaagtccgtacctgttgccctgggtgaggtttcagagaaacgggggcaggatgaacacagccggctgtcctgggtgcagttacgtccgtggagggtgagagattgcgccccgttccacacttgtgtcgcctgctgttgtctgtgggccttttctttccgtggtgcctggtgtgtgcgtgcatggcgtgagagaacggggggtgggggttggaggtggctccccgacaccggtgcctgtgtggcctgagccggcgccctcccgggagcgcccgtcacggggggcctctgtgattacctgctgctgctctctcccgcgtggtgactatatgtcctcagggctgcctgtggccaccctgatgggagacctctgtttgcttctgggccactgcaggttggcctcctcaatacaagctgatgtctgcagggagcgccgcgtgctgggattgcaccacgtgttggtcacaaatcgaggtcgccttttggcctggtctgctcaggctggccctgacccacgtggtttcctggcttctgagacgcagcgcattcttcctgttagcggtagcgttctctgatttcactgcttcattgccaagggcgtggaaagggggtggtggatggagccgggaggtggcgagcacaggaccccggggctgcattctgccgtgtggggttctgcactgtctagcttctgcggggactgcaaagagggatgaagggacgtggtcctaggggtcggctcagactcggagcagggcagggagaggagggcaaggagaggaggcctgggtcctggatccactgctctgggctcataaccatgagattttgaaagagtttttggtcatctgagcaggtaccatgcctggctcatgccggaacttgtcttggaaccggtagccagaggcccaggaagggacagggcccaaaagggttgcatgtcccggccacaaagccctccctgtgtgccctgagccagcccagcaagcgcctcccagccaggcgctttcgcagaagcaagagcacaggccagggggaccgggagagcctcagcccccagcctgggcggcctgtgaccctgagccgtgtggagccaggacccaagaaccttctctaggttctcaagggtgagctgacccgggcaatgtgcaggaatgtggggagcaaaagtagctgattccagccccgttctggggtcactggggaggcagaggctgagggcctgttctctggtcaccagggactgggggcacggtccacagcggatgagaacagcaggtcacagtagtggctttgggaagggcccctcctgctttgccctgttcggaaaggggctccctcagagcccctgggcccagtaacccgcttctgtctcctgactcctgctggataaattgccaggtttatcaaatacaagaaaacacctgctttggctaggaggtaagtcccaaaaagaacgtcttaagtagagcaaaggcatccaccgaggccatttggtggcccctgggaagtggggaagcagggcctgagcgtccccaggctgctagggcagcagctggctcagggcacactctctcgtgccagcttctgccaccagcccagtgtccacggagccgcggggccagaggagctcagggagacctggctgtctagggcatggtacccagtatcccggtgtgtgcccatcctcagccacttgtgtctttctttccatgtgggagttctcccggtgacacctgccctccgttgagggtggaatctgtcactcatgcctttgagggacccagatggaccatccctcttctgcttgctttctacattcctaaaaacctcaacgttaatccctcaccagtcgggccgagtgtggcctcatggttctgccgcggcccagtcttctcccactggcttcacgctagagggcgccatgcgctctgggtgaaatgagacgctggtgtggggtccccatgtagagaccctcaggtccctatccagagaccctccaggcagtgctgggaagacactggtggcggggaccatgaccaggcgggtggagccatgtgtgtctcacacctgccgcccctcactttccttcccgaggtctggtaggtcctctttgggatttgctgtttatttgtatctcccttttctttgatttaagaacaatgccaagtgaaaaagctgggaatgaatttctgagttgctgagtgttccctgctcctaggtaccacgctctgtgcttctcaggcagggaggagatggattcggtggagttgggccaggacgggggcttcaccctgccccctccagactgccgaagcccccaagaagttttgagcccagctgggcctcgcctccccggctcctgggtccattttctgtactggtttgagatcacaggcatcattcagcgaatgctcttgtgtcctctgcataaagagggccctccctggagcacccccggggagctgggactctccagaaagccccgggtgagggctccgtcttgagagagagagaaatcccttctttgggcgattcagtgagttcaggaggaggaggaagcttttccttggctttgaaatcagtgtttttatggagacaaagaacagacctcagtgggaaaaatgaaaacgtaatggaacacggggaggtgtcggagaagaaaggattttccccttcgctttcagagccggcgggagtgcaggtctgttttgcttcagaagcctcacattctgctttgcccttgagtgacttcatgcgggatgaggaactgttgacccctctagagaggacaccccaagtccatcctgggctcctcctcacccctctgagaaagcccccctaaaaaaaggcttcagagtcaccggcatgccgcctcacgttgcaggacggaatcgcgcgctcctcacgctggagtaagttacgaaacatgatcgtcaggctctttgcaaacgcagagccccagaacgctggatggaggcctcctcggccctgcgggcggcctggctgcggtaggtctgctgcaaggagccaccacggggactgcgccacactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgcggcccctcgcagggtggcgagtggggtccgtgcctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcactgacttctttttttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccactgacttctttagggaaaatagtttcagtcttgggttgtcttgtgagcccacgggcatgggaccctgtctctgctgggcttttccggccccgtcccagctcctcctcaggcagaggctgcagccctcagctctgctgctggatggaacatttcaaccccctccgggaaggtgggcagggtggagggcccagggctaggcctgccatgcaccatgagcaggggtgctacctgggtgtgtgaagttgggctggcttttcctggaggtgggtgagaaggctctccgggcaaatcagaaggccacgagagagagaggagcggggagagtggtgaggaggattcgtctctgactgatgaacctcgccgtgcctgtctgtcacatccaagtctgtgccagctgctgggaggtcagactcctgccctgagaaacagcccagtccttggagaatgaaaccctgagggtcagtgagtggaggccttccctcggggccagccattcccgggaggcctgagtgtgacctggaagctctgtgggtcaccaagactggcattttccttgtatttttgtgcagggctgaagtgagcgttcctcctctgaattggtgaggctttggaaattttttgtttcttctactcatcctaatggctggttttggctgcccggagtatcagagaatatcactaagagggcagtcagtttatttttaggcatctttctttctgtccagggagaaacccctcggaagaatcttagtcactctttgcacctgccctgtcattctcgccatggggaaaatgcgttgaaaagaaaaataccggggccagggagaagccgtgaatgtatttatttgctttggtgaagctgctgaacactggctgcggagggccccccgcccccatcccgcttcaggccccagtgacccagttgcgtcttaagttccatcgtccagatttcaggccaccagaggctgccaaaggtgactgaagcggtctccaagtcactctgtcaccactttttttttttttgagatggagtctcgctctatcgcccaggctggagtgcagtggcccaatctcggctcactgcaacctccgcctcccaggttcgagcgaattctcctgcctcaacctcccaagtagctgggattacaggcacctgccaccacacccggctaatttttgtatttctaatagagatgagagtgttaccatgttggtcaggctggtcttgaactcctgacctcaggtgatctgcccacctcaacctcccaaagtgctgggattataggcatgagccaccgcgcctggcctctgtcactttttttgctccttacccagtttttgttttttgttgttttgttttgttttagcgtgatactacaatggaaagactcctagttggttattctttatctcggattcttttttctggaattgtttgctcatttgagtggttggtggtttgccctgtgtcagacacggtgaaaagagtgcaggaaagctggggccaggggaagcgaagtggcttcaatccgggctgacagccaagaagagttttcctcccttcggtgacagggcctgcccctccgagtctagaggtaaaagcagcttctagaactggcccctaagtctccaaatgtgttggctaagctgaaatgagagactctgaattagagtttttgtttgtttgtttgttctctgcatgaagttcacaggcctgtatggatgttaaattgtgtctatagcctctaaatctccaggttaactggtccagattttttttttttaatcagtaacaatgggaatttaaaatcaaatatttggccaggtgcggtggctcatgcccgtaatcccagcactttgggaggccgaggcaggcgcatcacctgaggagtttgagaccagcctgaccaacatggtgaaatcctgtctctactaaaaatacaaaaaattagccaggcgtggtggcgtgtgcctgtaatcccagctaccagggaggctgaggcatgagaatcgcttgaacctgggagatggaggttgcagtgagccgagatcatgccactgcactccagcctgggcaacagagggagactctgtctcaaaaataataatcaaatcaagtattttaagtttggctcttctttttttcaagaaaggctttttggatacctagaataccttcatgtatgtggcttgatttctgtttcaggaaaaggggggcgggaggagagacaacagccgtgttccagagtctgtcctgagatgtcgctgagtccagacacttgggctgcacgtgccctgcagatgacaaaggccggcagctcagcacacgtgcaggaggggttaaagccaatattgagtttttgttcttgttgttttaatctgaacgattattctcctgtaaaaataatttgggaggggcgggtgttgttcggtgtgtgtgtgtgtgtgtgtgtgtgtgtgtgtgtgtgtatttttttttttacagtggcgcctgtctaaagtatttttcacaacatgtttgataatcagtgctttaaaaagcagcagtgtcctatgaagtggaaatgtcagttctagagcattggatgtgaagttctggtcatgtcaccttgcgtgtctcaccctggaggagtgaaggtgggcgcccggcgggggggtgtggctgcaccccagcaccgggagggggcacgcacgacaccagaggaagggacagccccacccatgtcaacagcaggcaacctgtgttttcatttcaagtgggatacagtatttttttaataaggagccatacttttttttaagagtttgagatctgaatgtgatttctaattgtatcagacgttaatgttttaaagctataacaaagtttaaaatttctactttttgtttttcatttattttaactgttcttttatctattaaattgttgtatgtggatggggaagttttgtttctcctcttagcatttgtttctataaccagaaataaaattctatattaaagaaatgac

SEQ ID NO: 387 - protein, 733 aa, Homo sapiens
MAEVGEDSGARALLALRSAPCSPVLCAAAAAAAFPAAAPPPAPAQPQPPPGPPPPPPPPLPPGAIAGAGSSGGSSGVSGDSAVAGAAPALVAAAAASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 388 - DNA, 1823 bp, Homo sapiens
gagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataaaaaaaaaaaaaaaaaa

SEQ ID NO: 389 - protein, 320 aa, Homo sapiens
MELLSPPLRDVDLTAPDGSLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 390 - DNA, 1576 bp, Homo sapiens
aaatggcacccagcagttggcgtgaggggctgctggagcttgggggctggtggcaggaacaagccttttccgaccccatggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttgcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatcccctttccagggaggtaaagcaggggaccagagcgccccctcgtgtatgccccagctcagggggcaaactcaggagcttcctttttatcataacgcggcctctaattccaccccccaagtgaaacggtttgagagacgcagtgccctgacctggacaagctgtgcacgtctcctgttctggtctcttcccgatgccagtggctgggctgggcctgccctgaattgagagagaagaaggggagaggaacagccctctgttcccaagtccctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcattgtgtggttttgccattgttttgtattttttttttttttttttttttttgctaacttatttggatttccttttttaaaaaatgaataaagactggttgccagaaaaaaaaaaaaaaaaaaaaaaaaaaaaaaaaaaaaaaaaaaaaa

SEQ ID NO: 391 - protein, 224 aa, Homo sapiens
MELYETSPYFYQEPRFYDGENYLPVHLQGFEPPGYERTELTLSPEAPGPLEDKGLGTPEHCPGQCLPWACKVCKRKSVSVDRRRAATLREKRRLKKVNEAFEALKRSTLLNPNQRLPKVEILRSAIQYIERLQALLSSLNQEERDLRYRGGGGPQPGVPSECSSHSASCSPEWGSALEFSANPGDHLLTADPTDAHNLHSLTSIVDSITVEDVSVAFPDETMPN

SEQ ID NO: 392 - DNA, 1520 bp, Homo sapiens
tctgcccttgttaattaccggagcgacagactagggagctccgcccgggatttgcccatcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatgcccgaatgtaacagtcctgtctggtccagaaagagcagtacttttgacagcatctactgtcctgatgtatcaaatgtatatgccacagataaaaactccttatccagcttggattgcttatccaacatagtggaccggatcacctcctcagagcaacctgggttgcctctccaggatctggcttctctctctccagttgccagcaccgattcacagcctgcaactccaggggcttctagttccaggcttatctatcatgtgctatgaactaattttctggtctatatgacttcttccaggagggcctaatacacaggaagaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttgcaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaag

SEQ ID NO: 393 - protein, 255 aa, Homo sapiens
MDVMDGCQFSPSEYFYDGSCIPSPEGEFGDEFVPRVAAFGAHKAELQGSDEDEHVRAPTGHHQAGHCLMWACKACKRKSTTMDRRKAATMRERRRLKKVNQAFETLKRCTTTNPNQRLPKVEILRNAIRYIESLQELLREQVENYYSLPGQSCSEPTSPTSNCSDGMPECNSPVWSRKSSTFDSIYCPDVSNVYATDKNSLSSLDCLSNIVDRITSSEQPGLPLQDLASLSPVASTDSQPATPGASSSRLIYHVL

SEQ ID NO: 394 - DNA, 4927 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaattgaaaaaaaaaaaaaaaaaa

SEQ ID NO: 395 - protein, 680 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 396 - DNA, 4833 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaattgaaaaaaaaaaaaaaaaaa

SEQ ID NO: 397 - protein, 586 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 398 - DNA, 2870 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggttt

SEQ ID NO: 399 - protein, 555 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 400 - DNA, 4697 bp, Homo sapiens
agagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaattgaaaaaaaaaaaaaaaaaa

SEQ ID NO: 401 - protein, 461 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 402 - DNA, 4603 bp, Homo sapiens
agagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaattgaaaaaaaaaaaaaaaaaa

SEQ ID NO: 403 - protein, 487 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 404 - DNA, 2640 bp, Homo sapiens
agagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggttt

SEQ ID NO: 405 - protein, 2640 aa, Homo sapiens
AGAGAGAGAAAGAGAGAGAGGGACTTGAGTTCTGTTATCTTCTTAAGTAGATTCATATTGTAAGGGTCTCGGGGTGGGGGGGTTGGCAAAATCCTGGAGCCAGAAGAAAGGACAGCAGCATTGATCAATCTTACAGCTAACATGTTGTACCTGGAAAACAATGCCCAGACTCAATTTAGTGAGCCACAGTACACGAACCTGGGGCTCCTGAACAGCATGGACCAGCAGATTCAGAACGGCTCCTCGTCCACCAGTCCCTATAACACAGACCACGCGCAGAACAGCGTCACGGCGCCCTCGCCCTACGCACAGCCCAGCTCCACCTTCGATGCTCTCTCTCCATCACCCGCCATCCCCTCCAACACCGACTACCCAGGCCCGCACAGTTTCGACGTGTCCTTCCAGCAGTCGAGCACCGCCAAGTCGGCCACCTGGACGTATTCCACTGAACTGAAGAAACTCTACTGCCAAATTGCAAAGACATGCCCCATCCAGATCAAGGTGATGACCCCACCTCCTCAGGGAGCTGTTATCCGCGCCATGCCTGTCTACAAAAAAGCTGAGCACGTCACGGAGGTGGTGAAGCGGTGCCCCAACCATGAGCTGAGCCGTGAATTCAACGAGGGACAGATTGCCCCTCCTAGTCATTTGATTCGAGTAGAGGGGAACAGCCATGCCCAGTATGTAGAAGATCCCATCACAGGAAGACAGAGTGTGCTGGTACCTTATGAGCCACCCCAGGTTGGCACTGAATTCACGACAGTCTTGTACAATTTCATGTGTAACAGCAGTTGTGTTGGAGGGATGAACCGCCGTCCAATTTTAATCATTGTTACTCTGGAAACCAGAGATGGGCAAGTCCTGGGCCGACGCTGCTTTGAGGCCCGGATCTGTGCTTGCCCAGGAAGAGACAGGAAGGCGGATGAAGATAGCATCAGAAAGCAGCAAGTTTCGGACAGTACAAAGAACGGTGATGGTACGAAGCGCCCGTTTCGTCAGAACACACATGGTATCCAGATGACATCCATCAAGAAACGAAGATCCCCAGATGATGAACTGTTATACTTACCAGTGAGGGGCCGTGAGACTTATGAAATGCTGTTGAAGATCAAAGAGTCCCTGGAACTCATGCAGTACCTTCCTCAGCACACAATTGAAACGTACAGGCAACAGCAACAGCAGCAGCACCAGCACTTACTTCAGAAACATCTCCTTTCAGCCTGCTTCAGGAATGAGCTTGTGGAGCCCCGGAGAGAAACTCCAAAACAATCTGACGTCTTCTTTAGACATTCCAAGCCCCCAAACCGATCAGTGTACCCATAGAGCCCTATCTCTATATTTTAAGTGTGTGTGTTGTATTTCCATGTGTATATGTGAGTGTGTGTGTGTGTATGTGTGTGCGTGTGTATCTAGCCCTCATAAACAGGACTTGAAGACACTTTGGCTCAGAGACCCAACTGCTCAAAGGCACAAAGCCACTAGTGAGAGAATCTTTTGAAGGGACTCAAACCTTTACAAGAAAGGATGTTTTCTGCAGATTTTGTATCCTTAGACCGGCCATTGGTGGGTGAGGAACCACTGTGTTTGTCTGTGAGCTTTCTGTTGTTTCCTGGGAGGGAGGGGTCAGGTGGGGAAAGGGGCATTAAGATGTTTATTGGAACCCTTTTCTGTCTTCTTCTGTTGTTTTTCTAAAATTCACAGGGAAGCTTTTGAGCAGGTCTCAAACTTAAGATGTCTTTTTAAGAAAAGGAGAAAAAAGTTGTTATTGTCTGTGCATAAGTAAGTTGTAGGTGACTGAGAGACTCAGTCAGACCCTTTTAATGCTGGTCATGTAATAATATTGCAAGTAGTAAGAAACGAAGGTGTCAAGTGTACTGCTGGGCAGCGAGGTGATCATTACCAAAAGTAATCAACTTTGTGGGTGGAGAGTTCTTTGTGAGAACTTGCATTATTTGTGTCCTCCCCTCATGTGTAGGTAGAACATTTCTTAATGCTGTGTACCTGCCTCTGCCACTGTATGTTGGCATCTGTTATGCTAAAGTTTTTCTTGTACATGAAACCCTGGAAGACCTACTACAAAAAAACTGTTGTTTGGCCCCCATAGCAGGTGAACTCATTTTGTGCTTTTAATAGAAAGACAAATCCACCCCAGTAATATTGCCCTTACGTAGTTGTTTACCATTATTCAAAGCTCAAAATAGAATTTGAAGCCCTCTCACAAAATCTGTGATTAATTTGCTTAATTAGAGCTTCTATCCCTCAAGCCTACCTACCATAAAACCAGCCATATTACTGATACTGTTCAGTGCATTTAGCCAGGAGACTTACGTTTTGAGTAAGTGAGATCCAAGCAGACGTGTTAAAATCAGCACTCCTGGACTGGAAATTAAAGATTGAAAGGGTAGACTACTTTTCTTTTTTTTACTCAAAAGTTTAGAGAATCTCTGTTTCTTTCCATTTTAAAAACATATTTTAAGATAATAGCATAAAGACTTTAAAAATGTTCCTCCCCTCCATCTTCCCACACCCAGTCACCAGCACTGTATTTTCTGTCACCAAGACAATGATTTCTTGTTATTGAGGCTGTTGCTTTTGTGGATGTGTGATTTTAATTTTCAATAAACTTTTGCATCTTGGTTT

SEQ ID NO: 406 - protein, 510 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 407 - protein, 416 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 408 - protein, 595 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 409 - protein, 501 aa, Homo sapiens
MLYLENNAQTQFSEYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 410 - protein, 676 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 411 - protein, 582 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 412 - DNA, 4627 bp, Homo sapiens
gcggcgggggcggccatcgtgctgcgcagcctgggcgcttggggagccgcccacttcgccgggtcgcgccccgacggccggagcgtggatgcggcggcgcccgccgagccggggcggacgcggggcggcccgggcccgggagacgcgccggcagccccggcaccgcagcggtcgcaggatggccgaggctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacaccaaaaaaaaaaaaaaa

SEQ ID NO: 413 - protein, 994 aa, Homo sapiens
MRRRPPSRGGRGAARARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 414 - DNA, 12926 bp, Homo sapiens
gaggcccggaggaactcggagggggagggagagaaaggccgagacggagggagccagcggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaagaaaaaaacatggtcttgtttttactacctgttagatatagtgctaaagaggtgctggcatgctttacagcacagatctgattttttaaaatgtcctgtactagtacataaatcccgtcatgcactttttttcatacactacaaggggatgtgtaataaccatgcttcttttttatccttaaactattgccatacttcagtaagtgtcttttttaaaaaaaattcacttgtataaaaatggtctggtcagtatagggcacaaatgccaaacaaagtattagtgttaacacaaaactgccaactttgcacaagtttccagaaaagaaaatacaattagtcactcaacataaccacaggccaatttgttggccaccagaaaaccgctttttaaaaaaacacttggtgattctttcaagtgccgaatgttattagaatcaacattgcatccttcttgcttatacgttaagttacataaaaggaaaacaaaattatgtggtgtgaaacagccaaggcatttattcttcagaggcaggataatatttcaggatacaaaagcccaaattacccgctacggaacaaagatgaatacagtaaaagagtcgaacactcatttccaaggccctaacccttatcctttaaaaagaaatcctctgaactgggtcggtctgttgtatggctgtctaatttgttgcaaattctgcagtcgtactataattcaggcctgtttggtagacaaaatcaaaaggcatttaacagcagcagtacttggaagctttgaaaacatgtgctaaacttgaatggagcaacactcctttctgaaaagccagaagaagggggttttaaagcaggatctctcaatgttcagtgttttgtgtttccccacacgatttgtcagagagaaatgaaagcaagcctgaaaccaagcaattgagagtgagaaagaggagagagactattctccaaaccttttttgttttgttttgtttccgatgtttacacatgttgcctgagctggttaaccacatcggcagcctcagctaccacaacatactgactaaatgatgatatttactcaagttcagtctgcagccaaaaccattagggtgtgcattgcagactgttttgttgtcttttttttttcttttttcctttttttttaagtggaggggaaaagaagagataaacaaggaatattttgtcaaacagtacacaataatttaaagagaatgtatttcttttttgcatttaatggcctcagacatttctttcatcagtctaaaagttagaaatatccctttattttaacttttatgtcgtttccatttttcatgtttttgtaattattttttctatgttcacatcagcattcacttccgttaaatttgccaaaggaaactgttaatatgtttctgttgttattattcctgtaggatttattgtacctcacagtatttattgtttcccaaaataagcatcattagttggggattcagtatttttgttgtgaaaatttcagaaacaatagattcttaaagataagctagctatgtctaggagctttatcttttcacctccttcagaggatgctatggggtccattttaattcttcatttgttctacggggaggaaagaccaaaagtatttgcagtacaaaagaaactatatcaaacactatgttaaatgacaagtgtttatggtaaaaagctgaggaattagtaataatcgtttttgttttcttgtactttgaattccccaaagtcttaattgctttattttggtgttgtgttaaattgaacagacagatgttttcctttgttttataccatataagactctgtacagtatgtttgtgaaagattgaactagaataatgaaagtttgtttgcaaacattttggtcctctcagcgttctctgtgttgtgctgttgccccattaccaaatggttagattcaaaaagggtgggaaaagatttttaatatcccaacaaaacattatagaaactctggcttttgcagtgtgcatagactacatgtagttttatgaaaataaatacacatttttatttcagcaactttgaaaagttacactcagttgagttactagaactcatcttgtacaacagcaatgtttagtctgtttaatttaatgtcaaataaaaggtcagatagccctcgtgagtgaattacatagctgtcggcagtcacatcagcaaatgcaccaggcttagaacaaatgtttgttacttgctgcaaaccaagctaatgtgtatagccagttagaaaaagtccagaagtaatgagattctagaagtagagtttcccttgcttggaaacatgaatgtgttcacctgtgttttgtcagagaagtggcaataagtcctggacagctgacactttttaagtatctcccctatttgctactacttttgtgcctcaagtgcccagtcgttacggtggccttctaaatgagtaaataacattttccaatataaagcctatttgcttaaaagggacaggggagtggatggatgtagtacatgcaatggaaaatcataaaatgtacaattcttctgtttccaaagtattgctcgttcttgagtgtgtgcctgagtgtcttgttttgacttaactagaattctagttaagatggtgatcccatggcttatttgcaaacaggaaggataaagagatcagcgttttagtcatggagctcatctttgcccattcctactcatttgctttttcataggagttttttgttgttaaacagtttctctcaagccacatgcattctatgctggctgaaaattaatagtgatgtagatgttcatccgacaagcttttccccatgtgattggttttagccagagtttatcacaggtacaaaattaggcggtatgactgtgcatgttctctagctgatgttgaaacttgtactgtcttgatcatttaaaactatgtttttgtaaatatcaggtttagtccgctttcgggaatatctgcatgctatggaaagagagaaaaaaaggatagataatgaggaatttggtttaaaagtgtgataaaaatccttggcattctttgttctgatattaattgtatttaaataagtcaacccaatgtaactcattccagatcttagtccagctgccctgttcagcctgatgccttttaaaggtttaaaggtgttaatgttttccttttcaacatggcaaacattttttaaaacctttttggcacaatggtgccactgtcctcatagtgttatttctttggtcatgaattttcaggcccttccagtaagaggagaaaggcacttaactggttaacagccccattattatacattgctctaaggaaaaaaaaaaaaaaaaaactttgaatatatcaagaatgggctattccagaggcttctcctcaggagaaactatgcactaggttcccaccaaatacaatgtgacctttttttcccctttctctgtacacaccccagatatgtgccaagcaaatgagaatgagggccgttgacaattaaagcataaagaagctagtcaccagattgagatggacatgctgctaactgctgacagcttgacctgagcagtcctaacttgtatctggtctgttagcattgggttagattgactaacagagtaaataaaattcacctgtcataagacacgctacatctgctatcatcaagaaacaaatcatccagaagaaactttttttcatcctgtggtcacacccttttcttaagagcttcttttttaaaattatgacaaacgaatttcattctttaaaatcacttatcttctcccaaacttgaagtatttaaattaggtggttttgcttttccctctcattgtttattttttggggatggatctaaatgagtaagatgagcaataaaagataccagaaagactggagggatcacagtgttttcatcagaactaagtagagggtcggttcctgccctggttttggggtagctagaaaaggaaatcatgaatgcactggaaatgttggctcgagagaaaagactggcatagctctgcctcgcagtgggtgagagcgtattgatcgtagggacctgcagagttcctatgaccaggtgagtcggctctgaggaaggggttaggaaagcaagtacagctgcatgaaatagctgaagttcctttggggtcaggaagagccgacaattgtggggttttggttgcttttgctttgtttttgagtgggaagtgttgctggaatcccctgagaaccgaaagatgccaggggtcagcaaggctatagaaaaggccagtggtaacacctcgttttcatcctaacagaggagtaggtgcgaatggcaccagcatggatcgttcctttcttgatcattactcatgcttgccactgtagcaacacaacaaagccatgattgtaattaatactaggctaaagaccttgatcaaaatgggagctcatttactgttctatgaggtatgtaagtaacttctcttcacattttccctcagagataaaccacacgtggtagtcttgtttgcgttagtactaaggtcatgtttgatctgtcccagacgagtcgcatatttcctgtagctggagtgttgctcaccataaatggtcattttcaaaaagtattgtgtaattccagctgtacaactgaccagtgagttatctgtcatcactgttgcccacatacccgtccttccttgtgtagtttcatcatcctcatccttcccacatcttgcgcaaaatgattttctgtgctcattcggcaataactatgttattcggcatactgtctttttggcatttgttgaaaaatccaaatgcttttaatccaaaagattaatccaaatcttttttaatccaaatgattttaatccaaatccaaataacaggaggttaaaaaaaaaaaaaaaactaagcatttttacatgtacactgaattggatcagcattattgttcattataatgctatatatatttttggagcaacatactatagttgtcataaaactatctttattcttctcctctaaagtgctgttgtaaattcatttgacctttactgcaggaaaaaaaaaaatcttttttatataggatatgaagaccaaggctcagtctgtaacaaatagtggaccattacaaaagaggaaagaaaaaagccagggctgagcagcaagaagcttcagttcaatttcacctcgtatctttctaataacatacttgtcactttattaccttccagtaatgtgaacgctgctgacaagactgtcacactaacagcagacaacaccctctctgcttcagcccagctctcctggctacttattgccctggccctgaagggacacaaactaatagtgtgctttccagttcagcacttggccatcaaatataaaaggatgcgtaattgcctgtttatccccttgtgaaggagaaattgactacaagggctaggctttcccatcgagttccctgatgtacacacacatccacaatcagtcagtctctctctctctctctctctctctctctctctctctctctctctcccctctctctctccttccctcttattctcccctcctaacatacaagcacatacacacacctactgtatctgtgggaagcccaaggctgcctctcgatgccctctccagctattaagtggacagtaacaagatgacttcttaaataaagggtcagtagagagatgctgtctgtgacggcatcctttgcttctttgaaaacttaagtgttaacaattccatcttgagagtaatgggtgtggccctataattagagcaaattttcctgcaagtcagtggcataagtaagattatattgccccctaatctgtagggaaaagattaaaatatttttcttccccttcaaaaagtgcacatgttgtaaactggttacgcacagtggtcatttttttttcttatccttggcatcaaaccatggacgtaggtgtacaaatgcatctttcaatgacccctccaaatccatagtgtaacatgatagattaacttttgtcaaactggactgacaatctaaaaaagatggcgtcaggcttttgactttaatcgttaaaacaaggaccaccctatgagtaaaaggtaaattctccactttgaagaactttggtaagtacaagtacagggagctttagaaaatcgagtgatggggaccaaaggtacaaaggaagaatacatgaaaatgttatattccaaaatgccctgagcccaaagattggctgctatttttgtatattgaaatactcaaatgatggttggaaagtgactagttagtgactaaatgaagtgcaagatctatcaagcgtcttctttctgggactaggggatgccatgcttccttccaaccttcccgcagcgcatctcagagaagatagttggccccattacaaacagtcacatttcagtaagatattagtcagccaggtaagacacgtgcaggtatcggtatcatcttccatatgaactttagcaaggagagaacagcagcagatttagggatagacaatgtaacaggtctatgttgacaaatctgtgctaaataatttcatgaaccagtgtggggactgggaagaaaagcactttgagcaaggactcttgggttcgagcaaaggcaattagttgacatgatacttcttaagttcctcagtatgtatatgttacaatcgtttatcagacatcttaatagaatcctaattgaaaaaccagttgccaaaattgcacaagttctgctcgctgatactagctttctccccttaactctaaaataccagggatgcttaaggacgtttgtaatagtttttttaatgctttgtttcacttttttaaaaaagaatctttgaagggaaggaagagcagaaagaagtattttaagaaaaatggagagaagtagatagtattgaaagtatatttcttgaagagagagtatctaagtgctataccaagattttatagggcttcctgttgccaaatgtgatgttgagataatgcacagctaagatggcaaatccatcaattattaactggctctgcccacttctgtcatggaatgcaaggattgagaggtgactctggggagaccctgggtgtgtgagagagctccattcatctggccctggatatgtttttcaaaagagagggagaaagcgccagtccctgcaaggtgaactgacctggcactgtttcagtgggagcctcactgcctgccttttccatgctaggagacaaagcatcctctaccccatctgtgaatcggtgctgtggccactgcgagaagcatgattcatgaggtatgatgctcttgagctcccagacaatgtgctgagttaataggttcacttgagatgtatacaccaaggctgtttctttttttaaatctagtccccaatttggagtatttttgcatgtttttgtacagagtaatccattcctctcattgtgtatcttaatctcctctgacttttccattgtctttctcaatcccaccctttgctcttcggatctcaccaaccccccttaaaaaataaatcatgtttgagcaagaaggtagaacacgccctccctcatcttggttttaattgctttggaaacgtgttctaccctgtccagggtttgcataacgtgaattaagtgaatgagatgttctagtattatatcttaacctgataagactatctaagatttctagtatatggtgcatttgctttcctgtgcaaactttggttcagctgccctgcagagaatctcaccattttcctgccagtgccagtataaagaatgcaggagagctaaacctgggtacatgaaggtcagaggggtgaggacggtcgagaaatggggagaagacttgggcttgagacgacctgggcttttcatgtgtagctcactcagcagtatgaggatgactgacacaccagtgggtggtttccaagtgaggcaaatgcccatttcccctctcccctcacaccttgcctggcttcttccatgaagtccttgctgcttttctgcctccccaaaggtgaggggaaggggctggttggggatctgggaaagccagttctctgttctctcctgctggtgatggactaggccttttagaactagcaagatccctcacacagctgggagaacacacacctttcttactccagacccattggtgtgtctccagtaacaaaattattggactcagcctccatatttgacagcaaaagtggccagagggagttgaaatatcttgaagaaaaggaattttcactaagatatgtcctctccctctcccagagtttagctgtttattccttttttttgtttatattgttctcatctgcataaaaccagtctcttgcaataagcctgccgcagaatcaaagtctgtacttcaaaaggtaactgcaccaagggatgggacagtgtgcatcaccctgatctaatcattgtgacgttggtagcttcctaaatactgtatgtaccttgaacaagggttttatttttgttttgttctgttttgctttttgtttttattggtaggctaaggtaattaaattttttaatttgctgttactttggttgtattttctgtactataactgcctacagtatgtcttttgcataaaatgcataagggtttggggatgtaaatggaattttattcatattttgtccaaatacctcttgtaatttgtatcaaaattcttgtacaatttttatattaaagatttatcagtcactga

SEQ ID NO: 415 - protein, 1099 aa, Homo sapiens
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 416 - protein, 903 aa, Homo sapiens
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRYWEKSNEQNGLLVSWGETLSSLK

SEQ ID NO: 417 - DNA, 1653 bp, Homo sapiens
acccgagcaccttctcttcactcagccaactgctcgctcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataaaaaaaaaaaaaaaaaaa

SEQ ID NO: 418 - protein, 472 aa, Homo sapiens
MTTCSRQFTSSSSMKGSCGIGGGIGGGSSRISSVLAGGSCRAPSTYGGGLSVSSSRFSSGGACGLGGGYGGGFSSSSSSFGSGFGGGYGGGLGAGLGGGFGGGFAGGDGLLVGSEKVTMQNLNDRLASYLDKVRALEEANADLEVKIRDWYQRQRPAEIKDYSPYFKTIEDLRNKILTATVDNANVLLQIDNARLAADDFRTKYETELNLRMSVEADINGLRRVLDELTLARADLEMQIESLKEELAYLKKNHEEEMNALRGQVGGDVNVEMDAAPGVDLSRILNEMRDQYEKMAEKNRKDAEEWFFTKTEELNREVATNSELVQSGKSEISELRRTMQNLEIELQSQLSMKASLENSLEETKGRYCMQLAQIQEMIGSVEEQLAQLRCEMEQQNQEYKILLDVKTRLEQEIATYRRLLEGEDAHLSSSQFSSGSQSSRDVTSSSRQIRTKVMDVHDGKVVSTHEQVLRTKN

SEQ ID NO: 419 - DNA, 2165 bp, Homo sapiens
ctctgcctcagccttactgtgagtctggttgacagtagcttctaagatgtcccagcaacacacactgccagtgaccctctcccctgccctcagtcaggagctcctcaagactgttcctcctccagtcaatacccatcaggagcaaatgaaacagccaactccactgcctcccccatgccagaaggtgcctgtcgagctcccagtggaggtcccatcaaagcaagaggaaaagcacatgactgctgtaaagggactgcctgagcaagaatgtgagcaacagcagaaggagccacaggagcaggagctgcagcaacagcactgggaacagcatgaggaatatcagaaagcagaaaacccagagcagcagcttaagcaggagaaaacacaaagggatcagcagctaaacaaacagctggaagaagagaagaagctcttagaccagcaactggatcaagagctagtcaagagagatgagcaactgggaatgaagaaagagcaactgttggagctcccagagcagcaggaggggcacctgaagcacctagagcagcaggagggacagctgaagcacccggagcagcaggaggggcagctggagctcccagagcagcaggaggggcagctggagctcccagagcagcaggaggggcagctggagctcccagagcagcaggaggggcagctggagctcccagagcagcaggaggggcagctggagctcccagagcagcaggaggggcagctggagctcccacagcagcaggaggggcagctggagctctctgagcagcaggaggggcagctggagctctctgagcagcaggagggacagctgaagcacctggagcaccaggaggggcagctggaggtcccagaggagcagatggggcagctgaagtacctggaacagcaggaggggcagctgaagcacctggatcagcaggagaagcagccagagctcccagagcagcagatggggcagctgaagcacctggagcagcaggaggggcagcctaagcatctggagcagcaggaggggcaactggagcagctggaggagcaggaggggcagctgaagcacctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcagagcctctacttgagggactattgttactataggaatccttacttccccagtattgaagctgaatcagtgagtgtgtacaatgatacataataaatcctggaagtcttgggatcctaaaaaaaaaaaaaaaaaaaaaaaaaaaaaaa

SEQ ID NO: 420 - protein, 585 aa, Homo sapiens
MSQQHTLPVTLSPALSQELLKTVPPPVNTHQEQMKQPTPLPPPCQKVPVELPVEVPSKQEEKHMTAVKGLPEQECEQQQKEPQEQELQQQHWEQHEEYQKAENPEQQLKQEKTQRDQQLNKQLEEEKKLLDQQLDQELVKRDEQLGMKKEQLLELPEQQEGHLKHLEQQEGQLKHPEQQEGQLELPEQQEGQLELPEQQEGQLELPEQQEGQLELPEQQEGQLELPEQQEGQLELPQQQEGQLELSEQQEGQLELSEQQEGQLKHLEHQEGQLEVPEEQMGQLKYLEQQEGQLKHLDQQEKQPELPEQQMGQLKHLEQQEGQPKHLEQQEGQLEQLEEQEGQLKHLEQQEGQLEHLEHQEGQLGLPEQQVLQLKQLEKQQGQPKHLEEEEGQLKHLVQQEGQLKHLVQQEGQLEQQERQVEHLEQQVGQLKHLEEQEGQLKHLEQQQGQLEVPEQQVGQPKNLEQEEKQLELPEQQEGQVKHLEKQEAQLELPEQQVGQPKHLEQQEKHLEHPEQQDGQLKHLEQQEGQLKDLEQQKGQLEQPVFAPAPGQVQDIQPALPTKGEVLLPVEHQQQKQEVQWPPKHK

SEQ ID NO: 421 - DNA, 2413 bp, Homo sapiens
tttggttttcccacagactcctgaagaataggtcagaagaaagggttaaagccttaaaaggggaacaaccattgcggggctcagggaggaggataatgttctttgggctgccgcaccctgatccccggggtcccgaaccctcccgtccctggccaggcctgccagccacagggtgagggcccccttccgccgcaacctgccactctcacaccaatgcgggaccgccttctcttccttccccaccccccaccccaccctgccgtcctttctcccccaatctccgcctctgattggctgagcccccggctccccgctccccctctcctccatccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgtcctcgtgtccacctggccttcgctcctccagcagtgcctgcctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgaaaaaaaaaaaaaaaaa

SEQ ID NO: 422 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 423 - DNA, 10724 bp, Homo sapiens
ctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcggacccaaccgctgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccattggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaacacagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacgctgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacgaatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctttggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaagatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagcctggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcatccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttccgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaaccttcgctttgtggagcaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctattctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaacccttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaagaaaaaaggaacagtgtaaatttgtaatcaagagtttgtgaggaaaaacttatggtttttggttttgtttgtttttgtaggtctgtgtatcaaatatgacacttttcttgcaataaagcttattttggggta

SEQ ID NO: 424 - protein, 2912 aa, Homo sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 425 - protein, 1473 aa, Homo sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQGGSPGFQLIFKLDQPQ

SEQ ID NO: 426 - DNA, 8814 bp, Homo sapiens
cccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 427 - protein, 2386 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 428 - protein, 642 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNDRTDSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 429 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 430 - protein, 2031 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQSTKA

SEQ ID NO: 431 - protein, 2211 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 432 - protein, 2184 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 433 - protein, 2446 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 434 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 435 - protein, 2240 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 436 - protein, 2240 aa, Homo sapiens; identical to SEQ ID NO: 435

SEQ ID NO: 437 - protein, 2386 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 438 - protein, 2008 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKENSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 439 - protein, 2267 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 440 - protein, 2265 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 441 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 442 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 443 - protein, 2330 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 444 - DNA, 8374 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 445 - DNA, 8272 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 446 - DNA, 7912 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 447 - DNA, 2402 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaaaaaaaaaaaaaaaaaaaa

SEQ ID NO: 448 - DNA, 8449 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 449 - DNA, 2151 bp, Homo sapiens
gcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccgctgagacttgaatcaatctggtctaacggtttcccctaaaccgctaggagccctcaatcggcgggacagcagggcgcgtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactcaaaaaaaaaaaaaaa

SEQ ID NO: 450 - protein, 466 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 451 - DNA, 6930 bp, Homo sapiens
gaccgttgcttggcagacactggatggttatgagcctgaacaagctgaaaaggggcaggaaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggaatgctgtcctgtctgttcacaaacacctggaggtggcaatacaaattttggtagaggaagaaagggacaaaagggagaaccaggattagtgcctgttgtaacaggcatacgtggtcgtccaggaccggcaggacctccaggatcacagggaccaagaggagagcgagggccaaaaggaagacctggccctcgtggacctcagggaattgatggagaaccaggtgttcctggtcaacctggtgctccaggacctcctggacatccgtcccacccaggacccgatggcttgagcaggccgttttcagctcaaatggctgggttggatgaaaaatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtgccaaaggcccaacgggctctccgggtacctctggtcctcctggctcagcagggcctcctggatctccaggacctcagggtagcactggtcctcagggaattcgaggccaaccgggtgatccaggagttccaggtttcaaaggagaagctggcccaaaaggggaaccagggccacatggtattcagggtccgataggcccacccggtgaagaaggcaaaagaggtcccagaggtgacccaggaacagttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcagagggcagcccgggagcatgggccttccaggccccaaaggtagcagtggtgaccctgggaaacctggagaagcaggaaatgctggagttcctgggcagaggggagctcctggaaaagatggtgaagttggtccttctggtcctgtgggcccgccgggtctagctggtgaaagaggagaacaaggacctccaggccccacaggttttcaggggcttcctggtcctccagggcctcctggagaaggtggaaaaccaggtgatcaaggtgttcctggagatcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaagaggtcttccaggtcctttgggccctccaggtccggcaggtcctactggagaaaagggtgaacctggtcctcgaggtttagttggccctcctggctcccggggcaatcctggttctcgaggtgaaaatgggccaactggagctgttggttttgccggaccccagggtcctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcttcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggaccacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcagtggtttttgttttgtgaaattcctttgaccatattagatctatttcatttccaatagtgaaaaggagatgtggtggtatactttgtttgccatttgtttaaaagatacaacggataccttctatcatgtatgtactggcttataaatgaaaatctatctacaacattacccacaaaggcaacatgacaccaattatcactgcctctgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactataagattatataagttcatatagatgaatcagaaatatgtggtaatactattaagtcacaaacactaacaatttccaactatagaaataacagttcttatttggattttgggaatgctaccaata

SEQ ID NO: 452 - protein, 1499 aa, Homo sapiens
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 453 - DNA, 5425 bp, Homo sapiens
ggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccaaaaaaaaaaaaaaaaaaaaaaaaaa

SEQ ID NO: 454 - protein, 1616 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 455 - DNA, 5377 bp, Homo sapiens
ggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccaaaaaaaaaaaaaaaaaaaaaaaaaa

SEQ ID NO: 456 - protein, 1632 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKRSRDPPASASQVTGIRAEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 457 - protein, 1280 aa, Homo sapiens
MARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 458 - DNA, 3332 bp, Homo sapiens
acttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatacgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaatcata

SEQ ID NO: 459 - protein, 646 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 460 - protein, 527 aa, Homo sapiens
MVYIVRQFLLYNVSGSVYLDQLIVLLTAKFSILRIAGSRVHHSPFSGHLDGCSFLSLQHSLHTSLDMSRHENVFLGLTLSSKSAGLKGFQLAFVPGLLQGTGGYLDGPLPTPVDNPRVGLEVGLRLSLPPLPPCPGVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTGKPGLAREQGCARASFLPCPSPESPVQKGE

SEQ ID NO: 461 - DNA, 2413 bp, Homo sapiens; identical to SEQ ID NO: 421

SEQ ID NO: 462 - protein, 161 aa, Homo sapiens; identical to SEQ ID NO: 422

SEQ ID NO: 463 - DNA, 2729 bp, Homo sapiens; identical to SEQ ID NO: 261

SEQ ID NO: 464 - protein, 349 aa, Homo sapiens; identical to SEQ ID NO: 262

SEQ ID NO: 465 - DNA, 2076 bp, Homo sapiens
agttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctaaaaaaaaaaaaaaaaaaaa

SEQ ID NO: 466 - protein, 272 aa, Homo sapiens
MATTGALGNYYVDSFLLGADAADELSVGRYAPGTLGQPPRQAATLAEHPDFSPCSFQSKATVFGASWNPVHAAGANAVPAAVYHHHHHHPYVHPQAPVAAAAPDGRYMRSWLEPTPGALSFAGLPSSRPYGIKPEPLSARRGDCPTLDTHTLSLTDYACGSPPVDREKQPSEGAFSENNAENESGGDKPPIDPNNPAANWLHARSTRKKRCPYTKHQTLELEKEFLFNMYLTRDRRYEVARLLNLTERQVKIWFQNRRMKMKKINKDRAKDE

SEQ ID NO: 467 - DNA, 2042 bp, Homo sapiens; identical to SEQ ID NO: 374

SEQ ID NO: 468 - protein, 2042 aa, Homo sapiens
GGAAAACGAGTCAGGGGTCGGAATAAATTTTAGTATATTTTGTGGGCAATTCCCAGAAATTAATGGCTATGAGTTCTTTTTTGATCAACTCAAACTATGTCGACCCCAAGTTCCCTCCATGCGAGGAATATTCACAGAGCGATTACCTACCCAGCGACCACTCGCCCGGGTACTACGCCGGCGGCCAGAGGCGAGAGAGCAGCTTCCAGCCGGAGGCGGGCTTCGGGCGGCGCGCGGCGTGCACCGTGCAGCGCTACGCGGCCTGCCGGGACCCTGGGCCCCCGCCGCCTCCGCCACCACCCCCGCCGCCCCCGCCACCGCCCGGTCTGTCCCCTCGGGCTCCTGCGCCGCCACCCGCCGGGGCCCTCCTCCCGGAGCCCGGCCAGCGCTGCGAGGCGGTCAGCAGCAGCCCCCCGCCGCCTCCCTGCGCCCAGAACCCCCTGCACCCCAGCCCGTCCCACTCCGCGTGCAAAGAGCCCGTCGTCTACCCCTGGATGCGCAAAGTTCACGTGAGCACGGTAAACCCCAATTACGCCGGCGGGGAGCCCAAGCGCTCTCGGACCGCCTACACGCGCCAGCAGGTCTTGGAGCTGGAGAAGGAATTTCACTACAACCGCTACCTGACACGGCGCCGGAGGGTGGAGATCGCCCACGCGCTCTGCCTCTCCGAGCGCCAGATCAAGATCTGGTTCCAGAACCGGCGCATGAAGTGGAAAAAAGACCACAAGTTGCCCAACACCAAGATCCGCTCGGGTGGTGCGGCAGGCTCAGCCGGAGGGCCCCCTGGCCGGCCCAATGGAGGCCCCCGCGCGCTCTAGTGCCCCCGCACGCGGGAGCCACGAACCTCGGGGTGGGGGTGGGCAGTGAGTGCAGGGGATGGGGTGGGGGGACAGGAGGGGGCCCTGGGGCCTGGGCCCCGGAAAAATCTATCTGCCCTCCCCCACACTTTATATACGAATAAACGCAGAAGAGGGGGAGGGGAAGCTTTATTTATAGAAATGACAATAGAGGGCCACGGGGAGGCCCCCCCAGAAGCAAGATTCAAATCTCTTGCTTTCTTTCTTAAAAAAAAGAAAAAGAAAAAGCAAGAAGAAGGAAGAAAGAAAAAGACAGAAAGAGAAATAGGAGGAGGCTGCAGCTCCTCGTTTTCAGCTTTGGCGAAGATGGATCCACGTTTCATCTTTAATCACGCCAGGTCCAGGCCCATCTGTCTTGTTTCCTCTGCCGAGGAGAAGACGGGCCTCGGTGGCGACCATTACCTCGACACCCGCTAACAAATGAGGCCCGGCTCGGCCGCCTCCGCCTCTGCTACTGCCGCTGCTGGAAGACAGCCTGGATTTCCTTTCTTTGTCCCCCACTCCCGATACCCAGCGAAAGCACCCTCTGACTGCCAGATAGTGCAGTGTTTTGGTCACGGTAACACACACACACTCTCCCTCATCTTTCGTGCCCATTCACTGAGGGCCAGAATGACTGCTCACCCACTTCCACCGTGGGGTTGGGGGTGGGCAACAGAGGAGGGGAGCAAGTAGGGAAGGGGGTGGCCTTGACAACTCAGGAGTGAGCAGGAAAATTGAGTCCAAGGAAAAAGAGAGACTCAGAGACCCGGGAGGGCCTTCCTCTGAAAGGCCAAGCCAAGCCATGCTTGGCAGGGTGAGGGGCCAGTTGAGTTCTGGGAGCTGGGCACTACTCTGCCAGTCCAGAGTTGTACAGCAGAAGCCTCTCTCCTAGACTGAAAATGAATGTGAAACTAGGAAATAAAATGTGCCCCTCCCAGTCTGGGAGGAGGATGTTGCAGAGCCCTCTCCCATAGTTTATTATGTTGCATCGTTTATTATTATTATTGATAATATTATTATTACTATTTTTTTGTGTCATGTGAGTCCTCTCTCCTTTTCTCTTTCTGACATTCCAAAACCAGGCCCCTTCCTACCTCTGGGGCTGCTTGAGTCTAGAACCCTTCGTATGTGTGAATATCTGTGTGCTGTACAGAGTGACAATAGAAATAAATGTTTGGTTTCTTGTGACCAGCAAAAAAAAAA

SEQ ID NO: 469 - DNA, 874 bp, Homo sapiens
agttcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatcc

SEQ ID NO: 470 - protein, 262 aa, Homo sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 471 - protein, 216 aa, Homo sapiens
MLPCPIPFSPSRLLIPPFPSFPSNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 472 - DNA, 2518 bp, Homo sapiens; identical to SEQ ID NO: 196

SEQ ID NO: 473 - protein, 435 aa, Homo sapiens; identical to SEQ ID NO: 197

SEQ ID NO: 474 - protein, 435 aa, Homo sapiens; identical to SEQ ID NO: 197

SEQ ID NO: 475 - DNA, 2500 bp, Homo sapiens
ggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatgggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaaaaaaaaaaaaaaaa

SEQ ID NO: 476 - DNA, 2233 bp, Homo sapiens; identical to SEQ ID NO: 199

SEQ ID NO: 477 - DNA, 4760 bp, Homo sapiens
gaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatatgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcaaaaaaaaaaaaaaaaaaaa

SEQ ID NO: 478 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 479 - protein, 570 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSANENREKVNDQAKLIVGIVVGLLLAALVAGVVYWLYMKKSKTASKHVNKDLGNMEENKKLEENNHKTEA

SEQ ID NO: 480 - protein, 133 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFSK

SEQ ID NO: 481 - protein, 305 aa, Homo sapiens
MDPVTQLYTMTSTLEYKTTKADIQMPFTCSVTYYGPSGQKTIHSEQAVFDIYYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 482 - DNA, 4923 bp, Homo sapiens
gcacgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacaggtctcccacaaaaaaaaaaaaaa

SEQ ID NO: 483 - DNA, 2075 bp, Homo sapiens
gcacgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcagtaagtagtctgcagcagtgtcactgctaagtgggattgatggccagtaccagaccatgttctttagaaagaagactgaactctctgtagtgtctctatagcaggtatctatataaggggacttaaagagatcttcattctgctcatatatactatcagcaaagaaaacaaagagtatgaaattcaaataggagatttgcagtgaggaactaaaataatattctctgttactttgtcatgtaaaaatgtcgtgagctatgaagtactactactgataactagcaggtgatcttaatttttactgacatgtacaaataagtgttgtgtgatacatacatagatatatgatatatatgtaatcatgtatatcacgcatacatatacatgtatttggctgaaccaaatgaaattgccattttgctgcataataaaaaaatataagcaaattcaaactatattttaacagaggtataaattttccatttatatatatccacatatataaatatcccatatatatccacatacaaatattttatatattatatatattagagatatagatacatttccatcctgacctttattgactggttattgatttagatttcaaaaagtattcacttgctttagaaaattgtcctaaaattaaaaaaactcactataccctgaatgcttatgtgggatacaccaaggggagaaagtagagtagtgatggaagaagagaaaattgtagaagaaacttggaataattatagtcactatgacaaaattactttgcctaatgatagcatatagttaatgttactgtgcaaataactgtgcaaatgaatgacttgagaagttataattaaagtatttcatcttttaaaactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 484 - DNA, 2961 bp, Homo sapiens
gcacgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagtgagttgtggaaaaaagatcttcatcgttcattgactttcactgggagaaaatacaatgtgctaattttgctcactccagtcgtgcatataatttatacaataaggaagatgtatccccaaatcaggttgattatatattttgtttcaactaattttgactacactgcctttgtcagggacatggcttgggatactgtttcacatgtgtccgtttatttgtctcaatcaatagcctgaattcaattatttgattttttcagtgcttgagtgaattttttaaagcgtatacttcctaaaggtcaacaaccatagactttttggttgaagttggagaagattcattaaaagtacctagtacatcttgtagggactgccaggtgtctttgcagtgacacatctggccagcaatgaaactgctgctgaggtaggaatatcttattgttattactcccatattctagttagttgactttgatccatataagagtctatatcagagaaaatcatgtcattatgtcaacttgagtttttaaaaatggattaaagtaccaacactacattaaaaatgctttagagatgttaaaaaaaaaaaaaaaaaa

SEQ ID NO: 485 - DNA, 4884 bp, Homo sapiens
gcacgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacaggtctcccacaaaaaaaaaaaaaa

SEQ ID NO: 486 - DNA, 3119 bp, Homo sapiens
cgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaaaaaaaaaaaa

SEQ ID NO: 487 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 488 - DNA, 2843 bp, Homo sapiens
cgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaaaaaaaaaaaa

SEQ ID NO: 489 - protein, 647 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQAFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 490 - protein, 677 aa, Homo sapiens
MPGKMVVILGASNILWIMFAASQAFKIETTPESRYLAQIGDSVSLTCSTTGSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 491 - DNA, 3220 bp, Homo sapiens
aaacttttttccctggctctgccctgggtttccccttgaagggatttccctccgcctctgcaacaagaccctttataaagcacagactttctatttcactccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaaaaaaaaaaaa

SEQ ID NO: 492 - DNA, 2944 bp, Homo sapiens
aaacttttttccctggctctgccctgggtttccccttgaagggatttccctccgcctctgcaacaagaccctttataaagcacagactttctatttcactccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaaaaaaaaaaaa

SEQ ID NO: 493 - DNA, 3034 bp, Homo sapiens
aaacttttttccctggctctgccctgggtttccccttgaagggatttccctccgcctctgcaacaagaccctttataaagcacagactttctatttcactccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaaaaaaaaaaaa

SEQ ID NO: 494 - DNA, 3977 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 495 - DNA, 4257 bp, Homo sapiens
atgtttaaggaatcctttccattacggcggccccatacctaggtccccgtccgggacagaggaagccgcaacgggtccccccgggcacccgggcctttctcctgcctcccgccacgtccgagggtccggccgcagcgccgcctgagcccctccgcggccggcagtgggaggcgggctctccgaaagccgtcgcggtggtcccagaagccgggtcataaataattcacgagccagggtctggcgagctaagggaagggcggcggcagcggtgactagggcgggagcaggagcgggagccgggtgcacgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 496 - DNA, 3973 bp, Homo sapiens
atgctctcagctctcccgccgcgggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 497 - DNA, 3857 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 498 - DNA, 3881 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 499 - DNA, 3884 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgacccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 500 - DNA, 3884 bp, Homo sapiens; identical to SEQ ID NO: 499

SEQ ID NO: 501 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 502 - protein, 856 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 503 - protein, 830 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDSSWVTSVQC

SEQ ID NO: 504 - protein, 833 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 505 - protein, 825 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDPSQH

SEQ ID NO: 506 - protein, 834 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDPSQH

SEQ ID NO: 507 - protein, 842 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 508 - DNA, 6063 bp, Homo sapiens
aatccctccctccggcgggcgtcgctggcgggtggctaggcccaacggcaggaagccgacgctatcctccgttccgcggcgccgggtccgccttccgtctgttctagggcctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaggaaaaaaagtttcatgatatctgttgttggcagtttttgtttatctctgacagtttttagttaaatgtttagatcctcagaactacattagtgcctactattaacttactctgtctcttgttaaaggctaaatctgcgcttctccctggtgccagcaggttcccctcacagtcaatgcagtggtatagcatatcctcacatttctagtgcccttgagactgtgctatggaaccaatcttgaacatacatgcattgacttgacaagttactgagtaagcagcatattcagcaggtgccactacatgcctactctgccagacactgagcttggggccctagggaagatagagaattatacaaggcaaagtccttctctttagggctcttacaatctatcacttccaaaaagtaaatggtgactgataaaacaattggcagaacctgtttgattactgtgacagtcttaatgataccataaatcaatattagaaagctagttgacttaaagcctgaaataatgggagttttctcctccacttattagaataaggaccctcagtgactaattattgtgggtagggtcaagattaactagttttatacagagttctgctgtaaatagtcattttgcatttgattagtgcagttctctgaatcataaagcaagttttacctctctgtacatgtttttgcagacatacttgaaaagctcacttaaatctaggtgcttcaattcactttcttgagaggacaaatgaaaagctgtggagaaaatgtcctcattaaagtattaaagtgtgggcagaattacaattacaaagtgccagccaccgaataaagataaaagttcagttcttaaaatgagtttttatgagataacagtcagtgatcttggtgttaccgggattccacatggggcagtgggaaagagttcaggttttgaaggtaacctagtttagatttgaattccagctatgtgacattgggtaaattagtagtagtcctgagcctcagcgtcctcatctataaaatgactggcgaaaatacttcacaagctcattttgagcactttaggaagtaagtgaaagtacctaaaatagcaggcacccaattgatgattttatatcttccttctttgcttgcagtgatttcaggatgtcctcatatctatttataggtctaaaattatatcttaaggtatgttgtagaataaattaaaaggataatctaaatcaccatttagattaagcttgacttgcaaactaggaagaagcacctaggctttctttgaaaatatttttttggttcgttttggtaaagctctataaattggtatctattattttaccaatttttttttagtattaagtccatttagaactaaccatattatttatggaataattagcatgaggaaggtataattgcatttttttttttttgagacggagtcttgcactgtagccccagctggactgcagtggcgtgatcttggctcactgcaacctccgcctcccaggttcaagcgattctcctgcctcagcctcccgagcagctgagactacaggcgcctgccaccacgcctggccaattttttgtatttttagtagagactgcgtttcaccatgttgggcaggctggtcttgaactcctgaccttgtgatccacctgcctcggcctctcagagagctgggattacaggtgtgagccgccgtgcccagccattgcatttttattcacatacacattgttaatgtggaacaatttaacactaatctcatcagagagcgagatgaatgtggcaattgctcattttattttgcatatattaaattgagtaggttcagctctaacataccttaagaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacggtctgacttgctttcagtattcacaagttctttccagtttccaagtcttttcctagcagtaatttaggggagacagaggagtttcatgtaaagagcatgcagtttggagtcagaacctgggtatgactctgtggccttgatgaagcaagttacttaaactcttgagttttagctttctcctttacaatgcatgaatgcctatccccctacaaaacaaagattaaatgtgatgatgtatgccaaggtgctttgtatattgtaaagtgctatataattataagatgttctaaattttcaaggatctaaaccagggattggcaaacgtttttccagggagtaaatattttacgctttgcatatataatttatggaggtgttgagaggatagattagacacttgaagtactcaggatagtgcctggcatgtaggaagcacctggaaaatattcgctgtgattaccatcagtccattttaccgaggaaggagccaaggtccaggcccactgaaggacttgcataacattacaatagcagtggcagaaccagccatgcttctgcaaatcacaacctctttgagcctctgtcacctgaactgcaaaatgagtgggttagacaaaatcatctgttgggacctcctagttccacgtgctatcattctactaactggcaccctaaggttgaaagtgcttatctgctttccaatgtggcttccttacagtctggaactgacaatatgcaggagcagtaaactggcagaaaaccaggaatcagagaaagaaaatataatttaactttaaagatgtaaattatatatatagtatattatatatatttttaaagctttatatgcctcaaatatcagggaaaggagccaagtccttggtatttagtttggtgaatacttgcattgaatacatgtcaagatgtcaagtcatttttgaatgtgtctcagggatttctatgctacacattcttttaacaaatcaagtatttatgtacacatgttcagattttttgacaaaatgattaaaataatgagatggaaaatgaaaaaaaaaaaaaaaa

SEQ ID NO: 509 - protein, 530 aa, Homo sapiens
MRRLWGAARKPSGAGWEKEWAEAPQEAPGAWSGRLGPGRSGRKGRAVPGWASWPAHLALAARPARHLGGAGQGPRPLHSGTAPFHSRASGERQRRLEPQLQHESRCRSSTPADAWRAEAALPVRAMGAPWGSPTAAAGGRRGWRRGRGLPWTVCVLAAAGLTCTALITYACWGQLPPLPWASPTPSRPVGVLLWWEPFGGRDSAPRPPPDCRLRFNISGCRLLTDRASYGEAQAVLFHHRDLVKGPPDWPPPWGIQAHTAEEVDLRVLDYEEAAAAAEALATSSPRPPGQRWVWMNFESPSHSPGLRSLASNLFNWTLSYRADSDVFVPYGYLYPRSHPGDPPSGLAPPLSRKQGLVAWVVSHWDERQARVRYYHQLSQHVTVDVFGRGGPGQPVPEIGLLHTVARYKFYLAFENSQHLDYITEKLWRNALLAGAVPVVLGPDRANYERFVPRGAFIHVDDFPSASSLASYLLFLDRNPAVYRRYFHWRRSYAVHITSFWDEPWCRVCQAVQRAGDRPKSIRNLASWFER

SEQ ID NO: 510 - DNA, 22 bp, Homo sapiens
ccacctacagcatgtcctactc

SEQ ID NO: 511 - DNA, 18 bp, Homo sapiens
gaccaccgaacccatgga

SEQ ID NO: 512 - DNA, 15 bp, Homo sapiens
ctggcatggctcttg

SEQ ID NO: 513 - DNA, 25 bp, Homo sapiens
ggccctcttttagtgatactggatt

SEQ ID NO: 514 - DNA, 19 bp, Homo sapiens
gtaggagggcagggatgtg

SEQ ID NO: 515 - DNA, 16 bp, Homo sapiens
acagccacaaacaacg

What is claimed is:

1. An in vitro method of transforming a cell of a first type to a hematopoietic multipotent cell, comprising:
   i) providing a cell of a first type, wherein the cell of the first type is a somatic cell that is multipotent, unipotent or terminally differentiated, but not a hematopoietic multipotent cell;
   ii) introducing into said cell of a first type reprogramming agent(s) or polynucleotides encoding said reprogramming agents) selected from the group consisting of:
      (1) Brachyury (T), Caudal Type Homeobox 4 (CDX4), Homeobox B4 (HOXB4), GATA Binding Factor 1 (GATA1), GATA Binding Factor 2 (GATA2), Kruppel-like Factor 1 (KLF1), Left-right determination factor 1 (LEFTY1), Eomesodermin (FOMES), Delta-like protein 1 precursor (DLL1), GATA Binding Factor 4 (GATA4), GATA Binding Factor 6 (GATA6), Heart and Neural Crest Derivatives Expressed-1 (HAND1), Insulin gene enhancer protein (ISL1), and NK2 Homeobox 5 (NKX2.5);
      (2) Eomesodermin;
      (3) CDX4;
      (4) KLF1;
      (5) Eomesodermin combined with Gata1, Gata2, Klf1, Cdx4, Tal1, Bmi1, Fli1, or HoxB4;
      (6) Cdx4 combined with Gata1, Gata2 or Klf1;
      (7) Gata1 combined with Fli1, Cdx4, HoxB4 or Eomesodermin; and
      (8) HoxB4 combined with Tal1, Fli1, Gata1, or Eomesodermin;
   iii) placing the cell of the first type in a hematopoietic cell culture medium and maintaining expression of the reprogramming agent(s) or polynucleotides encoding said reprogramming agent(s); and
   iv) maintaining the cell in hematopoietic cell culture medium for a sufficient period of time to allow a stable expression of a plurality of secondary genes whose expression is characteristic of phenotypical and/or functional properties of the hematopoietic multipotent cell, wherein at least one of said secondary genes is not characteristic of phenotypical and functional properties of an embryonic stem cell, whereby at the end of said period of time the cell of the first type has been transformed into the hematopoietic multipotent cell.

2. The method of claim 1, wherein said reprogramming agent(s) is/are polynucleotide(s) or polypeptide(s) having the sequence selected from the group consisting of:
   (a) Brachyury (T): SEQ ID NO: 196, SEQ ID NO: 197, SEQ ID NO: 198, or SEQ ID NO: 199;
   (b) CDX4: SEQ ID NO: 366 or SEQ ID NO: 367;
   (c) HoxB4: SEQ ID NO: 374 or SEQ ID NO: 375;
   (d) GATA1: SEQ ID NO: 370 or SEQ ID NO: 371;
   (e) GATA2: SEQ ID NO: 372 or SEQ ID NO: 373,
   (f) Klf1: SEQ ID NO: 376 or SEQ ID NO: 377;
   (g) LEFTY1: SEQ ID NO: 73, SEQ ID NO: 74 or SEQ ID NO: 75;
   (h) EOMES: SEQ ID No: 177 or SEQ ID NO: 178,
   (i) DLL1: SEQ ID No: 202, SEQ ID NO: 203 or SEQ ID NO: 204;
   (j) GATA4: SEQ ID No: 186 or SEQ ID NO: 187;
   (k) GATA6: SEQ ID No: 188, SEQ ID NO: 189, SEQ ID NO: 190 or SEQ ID NO: 191;
   (l) HAND1: SEQ ID No: 257 or SEQ ID NO: 258;
   (m) ISL1: SEQ ID No: 261 or SEQ ID NO: 262; and
   (n) NKX2.5: SEQ ID No: 254, SEQ ID NO: 273, SEQ ID NO: 274, SEQ ID NO: 275, SEQ ID NO: 276 or SEQ ID NO: 277.

3. The method of claim 1, further comprising contacting the chromatin and/or DNA of the cell of the first type with an agent capable of remodeling chromatin and/or DNA of said cell, wherein the agent capable of remodeling chromatin and/or DNA is selected from the group consisting of histone acetylators, inhibitors of histone deacetylation, DNA demethylators, inhibitors of DNA methylation and combination thereof.

4. The method of claim 1, further comprising treating the cell of a first type with a cytoskeleton disruptor.

5. The method of claim 1, wherein the cell of a first type is selected from the group consisting of: cells derived from mesoderm, endoderm or ectoderm, and a cell of mesoderm, endoderm or ectoderm lineage, skin derived precursor cell, hair follicle cell, fibroblast, keratinocyte, epidermal cell, endothelial cell, epithelial cell, granulosa epithelial cell, melanocyte, adipocyte, chondrocyte, hepatocyte, B lymphocyte, T lymphocyte, granulocyte, macrophage, monocyte, mononuclear cell, pancreatic islet cell, sertoli cell, neuron, glial cell, cardiac muscle cell, and other muscle cell.

6. An in vitro method of obtaining a hematopoietic multipotent cell, comprising:
   i) providing a cell of a first type, wherein the cell of the first type is a somatic cell that is multipotent, unipotent or terminally differentiated;
   ii) contacting chromatin and/or DNA of the cell of a first type with a histone acetylator, an inhibitor of histone deacetylation, a DNA demethylator, and/or an inhibitor of DNA methylation;
   iii) introducing into said cell of a first type reprogramming agent(s) or polynucleotides encoding said reprogramming agent(s) selected from the group consisting of:

(1) Brachyury (T), Caudal Type Homeobox 4 (CDX4), Homeobox B4 (HOXB4), GATA Binding Factor 1 (GATA1), GATA Binding Factor 2 (GATA2), Kruppel-like Factor 1 (KLF1), Left-right determination factor 1 (LEFTY1), Eomesodermin (FOMES), Delta-like protein 1 precursor (DLL1), GATA Binding Factor 4 (GATA4), GATA Binding Factor 6 (GATA6), Heart and Neural Crest Derivatives Expressed-1 (HAND1), Insulin gene enhancer protein (ISL1), and NK2 Homeobox 5 (NKX2.5);
(2) Eomesodermin;
(3) CDX4;
(4) KLF1;
(5) Eomesodermin combined with Gata1, Gata2, Klf1, Cdx4, Tal1, Bmi1, Fli1, or HoxB4;
(6) Cdx4 combined with Gata1, Gata2 or Klf1;
(7) Gata1 combined with Fli1, Cdx4, HoxB4 or Eomesodermin; and
(8) HoxB4 combined with Tal1, Fli1, Gata1, or Eomesodermin; and iv) culturing the cell of a first type in a hematopoietic cell culture medium and maintaining stable expression of the reprogramming agent(s), wherein the reprogramming agent(s) is capable of driving directly or indirectly transformation of the cell of the first type into the hematopoietic multipotent cell whereby a hematopoietic multipotent cell is obtained.

7. The method of claim 6 comprising transiently transfecting the cell of a first type with one or more expression vector(s) encoding the reprogramming agent(s), wherein the reprogramming agents(s) is/are selected from the group consisting of:
(a) Brachyury (T): SEQ ID NO: 197;
(b) CDX4: SEQ ID NO: 367;
(c) HoxB4: SEQ ID NO: 375;
(d) GATA1: SEQ ID NO: 371;
(e) GATA2: SEQ ID NO: 373;
(f) Klf1: SEQ ID NO: 377;
(g) LEFTY1: SEQ ID NO: 74;
(h) EOMES: SEQ ID NO: 178;
(i) DLL1: SEQ ID NO: 203, SEQ ID NO: 204;
(j) GATA4: SEQ ID NO: 187;
(k) GATA6: SEQ ID NO: 189 or SEQ ID NO: 190;
(l) HAND1: SEQ ID NO: 258;
(m) ISL1: SEQ ID NO: 262; and
(n) NKX2.5: SEQ ID NO: 273, SEQ ID NO: 275, or SEQ ID NO: 277.

8. The method of claim 6, wherein the hematopoietic multipotent cell so obtained possesses one or more of the following characteristics:
i) expression of one or more stem cell marker selected from the group consisting of CD34, Flt3, Sca-1, HoxB4, and CXCR4;
ii) decreased expression of one or more genes specific for the cell from which the HSC was obtained;
iii) capable of being cultured in suspension or as an adherent culture;
iv) capable of proliferating without the presence of an exogenous reprogramming agent for over 1 month, over 2 months, over 3 months, over 5 months or for more than a year;
v) positive for telomerase activity;
vi) capable of differentiation into cells according to the lineage of a hematopoietic multipotent cell;
vii) decreased expression of telomerase and one or more stem cell markers after differentiation;
viii) having one or more morphological features of a hematopoietic multipotent cell;
ix) expression of one or more antigen expressed specifically in a hematopoietic multipotent cell;
x) expression of one or more functional markers of lineage specific differentiated cells after differentiation of the hematopoietic multipotent cell;
xi) negative in a tumor colony forming assay;
xii) negative for tumor growth in SCID mice;
xiii) negative for teratoma growth in SCID mice; or
xiv) capable of significantly improving one or more functional measures after placement of an adequate number of hematopoietic multipotent cells in a model assessing the regenerative potential of hematopoietic multipotent cells.

9. The method of claim 6, wherein a plurality of hematopoietic multipotent cells are obtained and wherein said plurality of hematopoietic multipotent cells are organized within a three-dimensional structure.

* * * * *